United States Patent 7,842,459 (NUCLEOTIDE AND AMINO ACID SEQUENCES, AND ASSAYS AND METHODS OF USE THEREOF FOR DIAGNOSIS) - sequence listing, part 3

SEQ ID NO: 3740 - DNA, 9356 bp, Homo sapiens
gttttacgcctaccagttgaatttattggtatctttgaaattgatacctagcacaaagcaaacaatttatcttttcctctcttccgaatcttgctcttttgttttctctttttttggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatagtagtttcttaattgatttttataatcctagtctagctctcattgtcaagagtaccagattggtttttctgaaactcaaatataattactcataacctccattactttttatggtttcacaaggaattgcattttcttgtagaaaaatttgagaataaacaaaatacaaggaaatcacctgaaaagctgtcacacagataatcactaacattttggtatatgtatgttctttttctttgtattacggaaaatctcaaaaattacaaatgtttagaggatagtaaattgaatgtccacctttatcactttttttttttttgagatagagtttcactcttgttgcccaggctggagtgcagtggcatgatcttggctcacagcaacatccgcctctcaggttcaagcgattctcctgcctcatcctcccgagtagctgggattacaggcatgtgccatcatgctcggctaatttttagttttatcagagatggggtttctccatgttggtcaggctggtcttgaactcctgacctcaggtgacccgcccgcctcggcctcccaaagtgctgggattagaggcataagccaccacgcccagccaatcgctttttaattctgggatattttaacaaaaagctcagcaagactttttttatttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactgtaggcacttaccgctgtgatctgcttagctcatacattttaaaaaaatagttggttcaaatcaggatccaaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaaaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacagggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3741 - DNA, 8570 bp, Homo sapiens
gcctagtttgggattcccttgatggtcttcatttctttaatgggaactgtgctggtgactcaaatttatatctccagccagaacctttctcctgaattccagattcacatatccgactgtttactaggtgcttgataactatatctgtacttttcatcttgtttaatccaaatttacttcttttgcattttccttagttcaataaatgacaactttattcttccagttatttaaaccaaaaatcttagagtcattcttctcttccttccctcatatttcatgtctgattctaaaggaaatcttgttgcctgtactttttctttctttcctttttttcccctttttttgagtctcgcactgtcgcccaggctggagtgcagtagtgcaatctcagctgactgcaatctctgtgtcccgggttcaagcgattctcctacctcagcctcctgagcagctggggttacaggtgcatgccaccatgcctggctaatttttatatttttagtagagactgggtttcaccatgttggtaaggctggtctccaactcctgaccttgtgatctgcccgccttggcctcccaaagtgctgggattgcaggcgtgagccaccacatctggctttttttttttttttttttataaacagtttcacttcgtcacctgggctgaagtacagtggtgtgatcttggctcactgcaacatctgccccccgggtttaagtgattctcattccttggcctcccgagtagctgggactagaagtgtgcgccaccacacctggctaattttcttatttttagtagaaacgtggtttcaccatgttggccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattccatctggaaccttcctttaccatactcctgggtattcctgttggctgtttcatgttttggaattactgtttactgtgtcttgtgtctccccccccccctttttttttcctttaagacagagtttcactcttgttgcccaggctggagtgcaatggcttgatctcggctcactgcaacctctgtctcccaggtttaaactattctcctgcctcagcctcctgagtagctagaattacaagcgcccaccaccatgcccagctaatttttgtatttttagtagggacagggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccaagaaaagaattcaagggaaatgaattttttgagaactcgcatatctggctgtatttttgttggattcttatatttgatggatagttctggtttgggattttagagtaggaattattatcttctcagaatttcgaaagttgttgtgttgtctcagaacttccagtgttgtgggagagaaaattaatggttcctttttttttttttttttttgagacagggtctcattctgtcacctaggcatgaatacagctcactgcagccttgacctcccgggctcaagtgatcctcctgcctcagccaccaatttagtttggaccacagccatgcaccaaatgccctgctaaatttttaattttttgtggagacagggtctcaccatgttgcccaggctggtcctgaactcctgggctccagcaattccccccggcttggcctcccaaagggctgggattacaggtgtgagctcctgcacctggcccgaatgctgctttgatttccagtctgttgaaggtggggggaaccagccttttgttaatgtgagcttccagtgtttctttgtcttttgtattctaaattaataacacagtgatgtgtcttggtatgggtcttttttttttttctttttttttttcatttttaaagagactcctgctatgttgcacagacttgtgaattcctggtttcaagttatctttccccctatgtcactcaagtaatgtggactacactcatgtgacaccatgcccatctttatgttgtgtatcttatttttgttttgttttactcttgaatcagctcagtctgaaaatctgtcttttaattcatggggattttttagaatgatttcttggagggttttgtcttttgaatgtgtggtcccttctctgcctagaatttttttgtttgaatgagacatggtcttgctgttgtccaggttggagagcagtggtgcaactatagctcactacattcttgaatttctgggctcaagccatcttcccatctcagctttcagaatatcttggctacaggcatgtgacactatgcccagataatttaaaaaaaaaaaaaaaatttcttgagacagggtcttgctatgttgcccaggctcgtcttgaattcctgttctcagagggtcctcctatgtttgcttcccaaagcattggtattatatgtatgagccaccaccactagcacttctgcctagaactcgtaacaaaatttctttcccccatctgcatagtcttgtttcattaaatgattcttccctttttaaagtttagtctgtcttttattttgatgcttcttcaaatgccttgggatcatttactgttcctcaaatttaagagctagaagaaatctctctaagctccatgcatgagggttctcaacaggtggattttactccagtgtgatttcactagaccatttatttgagggtcacccaattgtcagtatatgtatatgagagagaatatgtacatatatatctgagagaaattctctaatcacttgtcctgtgtgagtatatgtactttgccagttttcttttggggtgaggaggagggacagtgtattagagattttactgttcaaaatgtagacttcctcagttttcagtaaaatactctaccctgtctatatgtggattcccctattccagactgattcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttcattttttacagtcatttagtttccagattttagtaagggacagaggggaatagatggactcatttcatgatgtagaaacaaatactccctgtcttgtcttacatgaaaaattattcttaaactaggccttgtctttgagaacctgatcaaagtataaaaaatactttttggctttatttctttagtgagtcactattccatattttgaaggtgttaagaggtatggtaaaggtggtacttgaacatttccaagcaaacgtgtgatgaaatctttcatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttagtggagacagggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3742 - DNA, 5816 bp, Homo sapiens
ttcatgccattctcctgcctcagcctcccgagtagctgggactacagtcgcccgccaccacgcttggctaattttttctatttttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacagggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3743 - DNA, 6899 bp, Homo sapiens
ttttcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacagggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3744 - DNA, 4869 bp, Homo sapiens
ttttttgagatggagtttcgctcttactgcccaggctggagtgcagtggtgcgatcttggctcattgcaacttccacctcccaggttcaagcgattctcctgcctccatcttccgagtaggtggcattacaggcatgtgccaccacgcccggcgagttttgtatttttagtagagatgaggtttctccatgttggtcaggctagtctcgaactcctgacctcaggtgatccacccaccttggcctcccaaagtgctgggattacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtatgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3745 - DNA, 5898 bp, Homo sapiens
ttcatgccattctcctgcctcagcctcccgagtagctgggactacagtcgcccgccaccacgcttggctaattttttctatttttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaattggagacagggtttcaccatcttggcctgactggtcccgaactgatctcaggtgatctgcccacctcggcctcccaaagtgctgggattacaagcgtgagccactgcgtggcctgagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3746 - DNA, 4425 bp, Homo sapiens
ttaaattagtctagaatatgtttataaatttatttacatttggttgaaatgtattcttaaaacttattccacagtttccagtttgaggataaatgaggtctaaagacagtatgaacttgttaataatttttcctattgtcctttttagaaatcttacatatcctttagcctaattatagattggccctgcaagcatgtcactgtatcttttatgtcttcctgagtcttagcactttaaattcttctatatccttcactgtctttcttacagcaccctaaaagagtagcatgtgaactgttgctcttctctaaggtattttaggacatttttaaaataatatatgagtggttgtcatgctaaatactgtctaccacaactcatacaattaaagtggtcaaagaaaggtctctttcatttcttttttcattttaaaaagaaatgttatttgtaaaacagtatagtcataacacagatatggcagttttttagtttttttttttctttttcttcactgtgtcatccaggcagtagcgtgattataattcactgcagcctccaactcctgggcttgagggatcctctcactgagccttctgagcagctgggactgcaaacgtgtgccagtactcctggctaatttttaaatttttttgtagaattgaggtgtttttttaaatttttttaaagccttgtttgcaaactgttgcaacttctggcggctgcaacttctggcctcaagcaatcttcctgtcttggcctcccaatagcataagctaccgcacccagcccacaattttctttcagtacaatataaacatcttgcaagcgctagcttgatttacactttttgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3747 - DNA, 3443 bp, Homo sapiens
ttttcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggctcggaggctccagcaatggttgaacaactggacactgctgtgattaccccggccatgctagaagaggaagaacagcttgaagctgctggactagagagagagcggaagatgctggaaaaggctcgcatgtcttgggatagagagtcgacagaaattcggtaccgtagacttcaacatttgcttgaaaaaagcaatatctactccaaatttttattgacgaaaatggaacagcaacaattagaggaacagaagaagaaagaaaaattggagagaaaaaaggagtctttaaaagttaaaaagggtaaaaattcaattgatgcaagtgaagagaagccagttatgaggaaaaaaagaggaagagaagatgaatcatacaatatttcagaggtcatgtcaaaagaggaaattttgtctgtggctaaaaaaaataaaaaggagaatgaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttaggatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaagctttgagtcttggtttgacatcactagtctttctgaaactgctgaagatattattgctaaagaaagagaacagaatgtattgcatatgctgcaccagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaagagctgttgtggaagtgaatatccctgtagaatctgaagttaatctgaagctgcagaatataatgatgctacttcgtaaatgttgtaatcatccatatttgattgaatatcctatagaccctgttacacaagaatttaagatcgatgaagaattggtaacaaattctgggaagttcttgattttggatcgaatgctgccagaactaaaaaaaagaggtcacaaggtgctgcttttttcacaaatgacaagcatgttggacattttgatggattactgccatctcagagatttcaacttcagcaggcttgatgggtccatgtcttactcagagagagaaaaaaacatgcacagcttcaacacggatccagaggtgtttatcttcttagtgagtacacgagctggtggcctgggcattaatctgactgcagcagatacagttatcatttatgatagtgattggaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaaatcatttcaaaggtggtcagtctggattaaatctgtctaagaatttcttagatcctaaggaattaatggaattattaaaatctagagattatgaaagggaaataaaaggatcaagagagaaggtcattagtgataaagatctagagttgttgttagatcgaagtgatcttattgatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggttattttgttttcttggtttcattcactagtactataggagtgtgtcatatagagatttcaagtggacattgtgttagcacaagagaagtttctgaatgaaactttagggtcttgagaaacgactagaaattggaaatggtagtgtatcatgcaaaacaagacagaccctgaaaatttatagtagtgggttaactagaaccaaatataagagaataggccttaggaatatgt

SEQ ID NO: 3748 - DNA, 129 bp, Artificial Sequence
  Synthetic oligonucleotide
ttttcccgcgaaggagaagcgcgcttttttccctggcgggggatttggctagaaggctgggccggcagcggttgtgaggagttagctcgcggcattgcaggctctgagaggaggggacccggttcccgg

SEQ ID NO: 3749 - DNA, 122 bp, Artificial Sequence
  Synthetic oligonucleotide
gctcggaggctccagcaatggttgaacaactggacactgctgtgattaccccggccatgctagaagaggaagaacagcttgaagctgctggactagagagagagcggaagatgctggaaaag

SEQ ID NO: 3750 - DNA, 123 bp, Artificial Sequence
  Synthetic oligonucleotide
gctcgcatgtcttgggatagagagtcgacagaaattcggtaccgtagacttcaacatttgcttgaaaaaagcaatatctactccaaatttttattgacgaaaatggaacagcaacaattagag

SEQ ID NO: 3751 - DNA, 2516 bp, Artificial Sequence
  Synthetic oligonucleotide
gttttacgcctaccagttgaatttattggtatctttgaaattgatacctagcacaaagcaaacaatttatcttttcctctcttccgaatcttgctcttttgttttctctttttttggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatagtagtttcttaattgatttttataatcctagtctagctctcattgtcaagagtaccagattggtttttctgaaactcaaatataattactcataacctccattactttttatggtttcacaaggaattgcattttcttgtagaaaaatttgagaataaacaaaatacaaggaaatcacctgaaaagctgtcacacagataatcactaacattttggtatatgtatgttctttttctttgtattacggaaaatctcaaaaattacaaatgtttagaggatagtaaattgaatgtccacctttatcactttttttttttttgagatagagtttcactcttgttgcccaggctggagtgcagtggcatgatcttggctcacagcaacatccgcctctcaggttcaagcgattctcctgcctcatcctcccgagtagctgggattacaggcatgtgccatcatgctcggctaatttttagttttatcagagatggggtttctccatgttggtcaggctggtcttgaactcctgacctcaggtgacccgcccgcctcggcctcccaaagtgctgggattagaggcataagccaccacgcccagccaatcgctttttaattctgggatattttaacaaaaagctcagcaagactttttttatttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactgtaggcacttaccgctgtgatctgcttagctcatacattttaaaaaaatagttggttcaaatcaggatccaaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaaaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccag

SEQ ID NO: 3752 - DNA, 601 bp, Artificial Sequence
  Synthetic oligonucleotide
gaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactag

SEQ ID NO: 3753 - DNA, 228 bp, Artificial Sequence
  Synthetic oligonucleotide
gatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagg

SEQ ID NO: 3754 - DNA, 183 bp, Artificial Sequence
  Synthetic oligonucleotide
atgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagat

SEQ ID NO: 3755 - DNA, 144 bp, Artificial Sequence
  Synthetic oligonucleotide
atccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacag

SEQ ID NO: 3756 - DNA, 197 bp, Artificial Sequence
  Synthetic oligonucleotide
cattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaag

SEQ ID NO: 3757 - DNA, 162 bp, Artificial Sequence
  Synthetic oligonucleotide
attttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgag

SEQ ID NO: 3758 - DNA, 630 bp, Artificial Sequence
  Synthetic oligonucleotide
ttcatgccattctcctgcctcagcctcccgagtagctgggactacagtcgcccgccaccacgcttggctaattttttctatttttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttag

SEQ ID NO: 3759 - DNA, 140 bp, Artificial Sequence
  Synthetic oligonucleotide
aaagaaacaattgagttaagtcctactggtcgaccaaaacgacgaactagaaaatcaataaattacagcaaaatagatgatttccctaatgaattggaaaaactgatcagtcaaatacagccagaggtggaccgagaaag

SEQ ID NO: 3760 - DNA, 139 bp, Artificial Sequence
  Synthetic oligonucleotide
agctgttgtggaagtgaatatccctgtagaatctgaagttaatctgaagctgcagaatataatgatgctacttcgtaaatgttgtaatcatccatatttgattgaatatcctatagaccctgttacacaagaatttaag

SEQ ID NO: 3761 - DNA, 160 bp, Artificial Sequence
  Synthetic oligonucleotide
aacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaa

SEQ ID NO: 3762 - DNA, 794 bp, Artificial Sequence
  Synthetic oligonucleotide
gtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggttattttgttttcttggtttcattcactagtactataggagtgtgtcatatagagatttcaagtggacattgtgttagcacaagagaagtttctgaatgaaactttagggtcttgagaaacgactagaaattggaaatggtagtgtatcatgcaaaacaagacagaccctgaaaatttatagtagtgggttaactagaaccaaatataagagaataggccttaggaatatgt

SEQ ID NO: 3763 - DNA, 4402 bp, Artificial Sequence
  Synthetic oligonucleotide
gcctagtttgggattcccttgatggtcttcatttctttaatgggaactgtgctggtgactcaaatttatatctccagccagaacctttctcctgaattccagattcacatatccgactgtttactaggtgcttgataactatatctgtacttttcatcttgtttaatccaaatttacttcttttgcattttccttagttcaataaatgacaactttattcttccagttatttaaaccaaaaatcttagagtcattcttctcttccttccctcatatttcatgtctgattctaaaggaaatcttgttgcctgtactttttctttctttcctttttttcccctttttttgagtctcgcactgtcgcccaggctggagtgcagtagtgcaatctcagctgactgcaatctctgtgtcccgggttcaagcgattctcctacctcagcctcctgagcagctggggttacaggtgcatgccaccatgcctggctaatttttatatttttagtagagactgggtttcaccatgttggtaaggctggtctccaactcctgaccttgtgatctgcccgccttggcctcccaaagtgctgggattgcaggcgtgagccaccacatctggctttttttttttttttttttataaacagtttcacttcgtcacctgggctgaagtacagtggtgtgatcttggctcactgcaacatctgccccccgggtttaagtgattctcattccttggcctcccgagtagctgggactagaagtgtgcgccaccacacctggctaattttcttatttttagtagaaacgtggtttcaccatgttggccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattccatctggaaccttcctttaccatactcctgggtattcctgttggctgtttcatgttttggaattactgtttactgtgtcttgtgtctccccccccccctttttttttcctttaagacagagtttcactcttgttgcccaggctggagtgcaatggcttgatctcggctcactgcaacctctgtctcccaggtttaaactattctcctgcctcagcctcctgagtagctagaattacaagcgcccaccaccatgcccagctaatttttgtatttttagtagggacagggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccaagaaaagaattcaagggaaatgaattttttgagaactcgcatatctggctgtatttttgttggattcttatatttgatggatagttctggtttgggattttagagtaggaattattatcttctcagaatttcgaaagttgttgtgttgtctcagaacttccagtgttgtgggagagaaaattaatggttcctttttttttttttttttttgagacagggtctcattctgtcacctaggcatgaatacagctcactgcagccttgacctcccgggctcaagtgatcctcctgcctcagccaccaatttagtttggaccacagccatgcaccaaatgccctgctaaatttttaattttttgtggagacagggtctcaccatgttgcccaggctggtcctgaactcctgggctccagcaattccccccggcttggcctcccaaagggctgggattacaggtgtgagctcctgcacctggcccgaatgctgctttgatttccagtctgttgaaggtggggggaaccagccttttgttaatgtgagcttccagtgtttctttgtcttttgtattctaaattaataacacagtgatgtgtcttggtatgggtcttttttttttttctttttttttttcatttttaaagagactcctgctatgttgcacagacttgtgaattcctggtttcaagttatctttccccctatgtcactcaagtaatgtggactacactcatgtgacaccatgcccatctttatgttgtgtatcttatttttgttttgttttactcttgaatcagctcagtctgaaaatctgtcttttaattcatggggattttttagaatgatttcttggagggttttgtcttttgaatgtgtggtcccttctctgcctagaatttttttgtttgaatgagacatggtcttgctgttgtccaggttggagagcagtggtgcaactatagctcactacattcttgaatttctgggctcaagccatcttcccatctcagctttcagaatatcttggctacaggcatgtgacactatgcccagataatttaaaaaaaaaaaaaaaatttcttgagacagggtcttgctatgttgcccaggctcgtcttgaattcctgttctcagagggtcctcctatgtttgcttcccaaagcattggtattatatgtatgagccaccaccactagcacttctgcctagaactcgtaacaaaatttctttcccccatctgcatagtcttgtttcattaaatgattcttccctttttaaagtttagtctgtcttttattttgatgcttcttcaaatgccttgggatcatttactgttcctcaaatttaagagctagaagaaatctctctaagctccatgcatgagggttctcaacaggtggattttactccagtgtgatttcactagaccatttatttgagggtcacccaattgtcagtatatgtatatgagagagaatatgtacatatatatctgagagaaattctctaatcacttgtcctgtgtgagtatatgtactttgccagttttcttttggggtgaggaggagggacagtgtattagagattttactgttcaaaatgtagacttcctcagttttcagtaaaatactctaccctgtctatatgtggattcccctattccagactgattcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttcattttttacagtcatttagtttccagattttagtaagggacagaggggaatagatggactcatttcatgatgtagaaacaaatactccctgtcttgtcttacatgaaaaattattcttaaactaggccttgtctttgagaacctgatcaaagtataaaaaatactttttggctttatttctttagtgagtcactattccatattttgaaggtgttaagaggtatggtaaaggtggtacttgaacatttccaagcaaacgtgtgatgaaatctttcatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttag

SEQ ID NO: 3764 - DNA, 850 bp, Artificial Sequence
  Synthetic oligonucleotide
ttaaattagtctagaatatgtttataaatttatttacatttggttgaaatgtattcttaaaacttattccacagtttccagtttgaggataaatgaggtctaaagacagtatgaacttgttaataatttttcctattgtcctttttagaaatcttacatatcctttagcctaattatagattggccctgcaagcatgtcactgtatcttttatgtcttcctgagtcttagcactttaaattcttctatatccttcactgtctttcttacagcaccctaaaagagtagcatgtgaactgttgctcttctctaaggtattttaggacatttttaaaataatatatgagtggttgtcatgctaaatactgtctaccacaactcatacaattaaagtggtcaaagaaaggtctctttcatttcttttttcattttaaaaagaaatgttatttgtaaaacagtatagtcataacacagatatggcagttttttagtttttttttttctttttcttcactgtgtcatccaggcagtagcgtgattataattcactgcagcctccaactcctgggcttgagggatcctctcactgagccttctgagcagctgggactgcaaacgtgtgccagtactcctggctaatttttaaatttttttgtagaattgaggtgtttttttaaatttttttaaagccttgtttgcaaactgttgcaacttctggcggctgcaacttctggcctcaagcaatcttcctgtcttggcctcccaatagcataagctaccgcacccagcccacaattttctttcagtacaatataaacatcttgcaagcgctagcttgatttacacttttt

SEQ ID NO: 3765 - DNA, 818 bp, Artificial Sequence
  Synthetic oligonucleotide
ttttttgagatggagtttcgctcttactgcccaggctggagtgcagtggtgcgatcttggctcattgcaacttccacctcccaggttcaagcgattctcctgcctccatcttccgagtaggtggcattacaggcatgtgccaccacgcccggcgagttttgtatttttagtagagatgaggtttctccatgttggtcaggctagtctcgaactcctgacctcaggtgatccacccaccttggcctcccaaagtgctgggattacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtatgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactag

SEQ ID NO: 3766 - DNA, 476 bp, Artificial Sequence
  Synthetic oligonucleotide
cactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggt

SEQ ID NO: 3767 - DNA, 470 bp, Artificial Sequence
  Synthetic oligonucleotide
gcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccag

SEQ ID NO: 3768 - DNA, 3105 bp, Artificial Sequence
  Synthetic oligonucleotide
gctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggcttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaaaacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgagactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccgagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 3769 - DNA, 45 bp, Artificial Sequence
  Synthetic oligonucleotide
gtgagtgtccaggcatgccagcggaacggcccgcgggcagcggcg

SEQ ID NO: 3770 - DNA, 57 bp, Artificial Sequence
  Synthetic oligonucleotide
gaacagaagaagaaagaaaaattggagagaaaaaaggagtctttaaaagttaaaaag

SEQ ID NO: 3771 - DNA, 37 bp, Artificial Sequence
  Synthetic oligonucleotide
ggtaaaaattcaattgatgcaagtgaagagaagccag

SEQ ID NO: 3772 - DNA, 65 bp, Artificial Sequence
  Synthetic oligonucleotide
ttatgaggaaaaaaagaggaagagaagatgaatcatacaatatttcagaggtcatgtcaaaagag

SEQ ID NO: 3773 - DNA, 42 bp, Artificial Sequence
  Synthetic oligonucleotide
gaaattttgtctgtggctaaaaaaaataaaaaggagaatgag

SEQ ID NO: 3774 - DNA, 97 bp, Artificial Sequence
  Synthetic oligonucleotide
ctttgagtcttggtttgacatcactagtctttctgaaactgctgaagatattattgctaaagaaagagaacagaatgtattgcatatgctgcaccag

SEQ ID NO: 3775 - DNA, 84 bp, Artificial Sequence
  Synthetic oligonucleotide
atcgatgaagaattggtaacaaattctgggaagttcttgattttggatcgaatgctgccagaactaaaaaaaagaggtcacaag

SEQ ID NO: 3776 - DNA, 82 bp, Artificial Sequence
  Synthetic oligonucleotide
gtggtacttttgattggaattttggattgttcaattatttttttatcaatcattagaaatattaagatatgtttaatttcag

SEQ ID NO: 3777 - DNA, 26 bp, Artificial Sequence
  Synthetic oligonucleotide
gtgctgcttttttcacaaatgacaag

SEQ ID NO: 3778 - DNA, 94 bp, Artificial Sequence
  Synthetic oligonucleotide
catgttggacattttgatggattactgccatctcagagatttcaacttcagcaggcttgatgggtccatgtcttactcagagagagaaaaaaac

SEQ ID NO: 3779 - DNA, 117 bp, Artificial Sequence
  Synthetic oligonucleotide
atgcacagcttcaacacggatccagaggtgtttatcttcttagtgagtacacgagctggtggcctgggcattaatctgactgcagcagatacagttatcatttatgatagtgattgg

SEQ ID NO: 3780 - DNA, 97 bp, Artificial Sequence
  Synthetic oligonucleotide
atcatttcaaaggtggtcagtctggattaaatctgtctaagaatttcttagatcctaaggaattaatggaattattaaaatctagagattatgaaag

SEQ ID NO: 3781 - DNA, 77 bp, Artificial Sequence
  Synthetic oligonucleotide
ggaaataaaaggatcaagagagaaggtcattagtgataaagatctagagttgttgttagatcgaagtgatcttattg

SEQ ID NO: 3782 - DNA, 80 bp, Artificial Sequence
  Synthetic oligonucleotide
atcaaatgaatgcttcaggaccaattaaagagaagatggggatattcaagatattagaaaattctgaagattccagtcct

SEQ ID NO: 3783 - DNA, 4 bp, Artificial Sequence
  Synthetic oligonucleotide
gaat

SEQ ID NO: 3784 - DNA, 117 bp, Artificial Sequence
  Synthetic oligonucleotide
tggagacagggtttcaccatcttggcctgactggtcccgaactgatctcaggtgatctgcccacctcggcctcccaaagtgctgggattacaagcgtgagccactgcgtggcctgag

SEQ ID NO: 3785 - DNA, 1429 bp, Homo sapiens
gtctttacctcttgctcccgccagagtttgggatcggtctcttctgttccgcgtcctccacctcggtagcccctggtgactctgttacagcctctgttgacctatgatctgcagggagacgcacagccaggacatcctggaacctgggaaaggggactcttgacgtttaggtatgtggccatagaattctctctggaggagtagcagtgcctggacactgcacagcagaatttatagaggaatgttatgaaaacctggccttcctgggtattactgtctctaagccagacctgatcacctatctggagcaagaaaaagagccctggaatatgaagtgacatgagatggtggatgaacccccagtaacaatgctgcagcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaaaaaaaaa

SEQ ID NO: 3786 - DNA, 3985 bp, Homo sapiens
gtctttacctcttgctcccgccagagtttgggatcggtctcttctgttccgcgtcctccacctcggtagcccctggtgactctgttacagcctctgttgacctatgatctgcagggagacgcacagccaggacatcctggaacctgggaaaggggactcttgacgtttaggtatgtggccatagaattctctctggaggagtagcagtgcctggacactgcacagcagaatttatagaggaatgttatgaaaacctggccttcctgggtattactgtctctaagccagacctgatcacctatctggagcaagaaaaagagccctggaatatgaagtgacatgagatggtggatgaacccccaggtatatgccctcattttgcttaagacctctggccagagcagggcatggaagattccttttaaaaagtaatactgagaagacatgaaaaatgtggacatgataatttactgttgagaaatggctgtaaaagtgtggatgagtgtcaggtgcacaaagaaggttataatggacttaacaagtgtttcacaactactcagagcaaagtatttcaatgtggtaaatgtttgaaagtcctttataaatttttaaattcaaacaaaaaataagatatactggaagaaaacctttcaaatgtcaaaaatgtgtcaaatcattttgcatgctttcacacaaaacccaacataaaagcatttatactagagagaagtcctacaaatgtaaaaaatgtggaaaaacctttaattggtcctcaatccttactaataataagaaaattcatactgaatagaaaccttacaaatgtgaagaatgtggcaaagcttttaagcaacactcaacccttactacacataaaataatttgtgctgaagaaaaactttacagatgtgaagaatgtggcaaagcattttgccagccctcaaccctaactagatataagaggatgcacggaagaaagaaactctacaaatgtgaagaatgtggcaaagcgtttacccagttctcaacccttactaaacataagagaattcatactagagggaaacattacaagtgtgaagaaagtggcaaagcatttatctggtcctcaggccttactgaacataggagagttcatactagacagaaaccctacaaatgtgaagaatgtggcaaagcattaattcaattctcaaccctaactagacataagaggatacacactggagagaaacccaacaaatctatgtggcaaaccttttagccaaaactcaaaccttactatatataagataattcatactgaaaagaaaccctacaaatgtcaagaatgtggcaatgcttttagccagtccccataccttactacacataaggtaattcatactgggagagaccctacaaatgtgaagaaggtggcaaagcatttctatggttcattaccctaactggtcataagaggatgcacactggagagaaaccctacaaatgtgaagaatatgaaaaagcttttagccagtcatcaatccttactcgacataagataattcatactggagagaaaccttacaaatgtgaagaatgtggcaaagctttcagccagtcctcaacccttactacacataagagaattcatactggagagaaaccctacaaatgtgaggaacgtggcaaatcttttaacctgtcttcaagctttactaaacataaggtaattcacagtggagtaaaaccctacaagtgtgaagaatgtggcaaagcctttaggcagtcttcaatttttgctaaccataagagaattcatactggaaagaaaccctacaagtgtgaagaatgtggcaaatcttttaacctgtcttcaagctttactaaacataaggtaattcttactggtttaaaaccctacaaatgggaagaatgtgccaatgccttttcctggtcctcagccctaactaaacataagaaaatttatacttgaaagcaaccctacaaatgggaaaaatttggcaaagcctttaatccttacaacttaatgcacataagataacttatattgaagagaaatattacaagtgtgaataatgtgtcaaagcctataaaaagtcctcaattctttacagacataaggttatttatactggagagaaactttgcaaacctgaaagatgtgccaatgcttttgacaacaacttaagcttttctaaacataaagaaaatcatgctgctgagaatcctagaagtgtgaagaatgtgacaaagcctttaaatgattgtcacacttgattgtaggtaaggtaattcatactggagataactatcagtgtgtacaatgtggccaagcttctaactaatgctcacacgttattgcacaggaaagcatttataagcatttatacttgagaacaaatgtgcaaatataaagtaaaaaagccattaatacctgctcacatcttactcaaaatcagatagttcatatgaaataaaagcataaaagtgtaattactgtccaaagatctattagaaaatatgtctttaaagtgcagaagagtatttactttaaaaaagcactacaaatataaatagggttgtaatacctttacttgtatcagaaatcttattgtacacattttgtgctagaggaaaaccctgaggcagttgttaaaattttgtccaacatcagtgagtttatattgaagaaaaccctgcaaatataataaatttggaaaaacattttttcaaaaactacaaattataaaacaccaaagagtttatactaaaatatatttttgcaggtgcagtaaatatgaaagatatttaatccaaaattgtctatgtaaatatcagaataatccacagtagaaatatctagggccactcaatgtttagacactactgtaaatcagagtgctgcgtataaaaaataatacaaaactatagatagcataaacattatttgtatataactttaaaagaagtagaatattttttggagagttataattacattcaaattatactttttatgaaaatacaggtttttttcgaagtgaataataatgaagttaaactcttaaattacttcatgctcttccatcattcctggtttattcaaatgtgaaagcatgtgactaattgttgctggacaaaatatatgagagattcttgtttattaggtaagcattacttatgaccttttctatggaaaggtaaggacattaaaatgtaaggtgcataatgaaaatttaagtagagaggctctttgtggttaacttataatattttgtgatacatgaggtaggtgttcagagtaatactcttctgcattattatgaaagaaaaatattcttaattttagttaaaattaggttagtaatgttattttattaattgcacttttatggaatactatacggcatatttttaagttataaattatttgtgaaattaacttttcaattccacatttttaacatgttaaatactatcatgaatccattgaaatgttattgtgccactaactttaacctattccatcttacacaagggtgtaggtaacaatacattatttggtaagataatggactgacatcgctagtaatcttttttgccagtaactttaaatggccaataagttaaaaaatattgttcctataggttatatttttattcttattttcacatttaaatgtatttttcttaatttctgtggatatatgtttatatgtttatgccatatatggcatattttaatacaggaatacaaaatatgataatcacattagaggaaatgagatgtccattacctctagcatttattctttgtattacaagcaattcaattctacagtttaagttatttttaatgtacaattaaattgttattgactacagggtcatttttatcatcataatacaaattatatacaaacatgtaaaatccatacatttctgagtccttaataaatatttttataaattttaatat

SEQ ID NO: 3787 - DNA, 1698 bp, Homo sapiens
gtctttacctcttgctcccgccagagtttgggatcggtctcttctgttccgcgtcctccacctcggtagcccctggtgactctgttacagcctctgttgacctatgatctgcagggagacgcacagccaggacatcctggaacctgggaaaggggactcttgacgtttaggtatgtggccatagaattctctctggaggagtagcagtgcctggacactgcacagcagaatttatagaggaatgttatgaaaacctggccttcctgggtattactgtctctaagccagacctgatcacctatctggagcaagaaaaagagccctggaatatgaagtgacatgagatggtggatgaacccccaggtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagagatctccataattttgagatactctatgttaaactattttttaagttctctttttacatcacgtctgaaatgcacgagagtggcggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatgtatgttttagggttgtgtttttcattactgtgaaaaaagaacactggaattttgacagggagtttattgaatctagagatcactttggataatatggcagtttcacaatacttattctttcagtagaaataaaatatttttaaatttatttgtgtcctctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgttttttttttatatataagattacatggtctaccaacagcaatgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggccccccaatgtgatagaatgccctctgggtttgtggtgaagaagggttgtagcttggtcttaaggctgctgggtttgcacaagggttcacctttagttgtcttgttaaaaggggcttggataggctgggtgcggtggctcatgcctgtaatcccagcactg

SEQ ID NO: 3788 - DNA, 1064 bp, Homo sapiens
gtctttacctcttgctcccgccagagtttgggatcggtctcttctgttccgcgtcctccacctcggtagcccctggtgactctgttacagcctctgttgacctatgatctgcagggagacgcacagccaggacatcctggaacctgggaaaggggactcttgacgtttaggtatgtggccatagaattctctctggaggagtagcagtgcctggacactgcacagcagaatttatagaggaatgttatgaaaacctggccttcctgggtattactgtctctaagccagacctgatcacctatctggagcaagaaaaagagccctggaatatgaagtgacatgagatggtggatgaacccccaggtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagagatctccataattttgagatactctatgttaaactattttttaagttctctttttacatcacgtctgaaatgcacgagagtggcggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatgtatgttttagggttgtgtttttcattactgtgaaaaaagaacactggaattttgacagggagtttattgaatctagagatcactttggataatatggcagtttcacaatacttattctttcagtagaaataaaatatttttaaattta

SEQ ID NO: 3789 - DNA, 2530 bp, Homo sapiens
tctccatttttgcctacactctgcccacagaaaaattatcactaggcccaggtaccagacaatgtgtctttcttgcatggccttttaccatagaaagcattgttacctattgctgggctcagcacctaggtgatgtcattgctgcctgtcgtgctttcaggagaaggttgtaacatattcctggctgagtattaaagtgatgtgacactcctgtctggtccctgccctcaggaaagattgtgatgtattcttggccaaaaaacccaggtgatgttaccctcctcctttctgcctgttcacaggtgggattgtaaaatatattttggtctagctcacaggtgcaatggtgactctcatacctcaaaccatctaataggagaggtgctgtcttttatagctaggcctagggtaatgattaagatcctcggtctccttttttgtacaaagtcataggaaattaccactttcttgtatactatacacatctcttgtggtacagtgagtgtcattccagggttcagcacacaggtgagattgtggttctcatgtgcacaccccaccaattgttagaattgtcaccataatacaatccacagttaaaattgtgactgtcatatgtgaacatccagccagagttggaatgatgatttatttctaaatccagtactttagcgggtgaaaattctatctggacccatgaaaaatttacctgggcttagggccagagtaaacacagtttacaggaggaatgaaggctctcatgtgccaatccagttcattggtgaaattgtcagtactgtacttagacccaacatagaaaatgtggtgattctcttacctagaactgggacctgtgcgggattgttaatttattactggaccttcctgcgggagtgattatcacatatgcctatgttcagcacctgagtgatttgattttgctgcctggtcccagtctgaaggctccgcatatttgggtattgtgacatattgctgaactcaacacctaagggatgagagtctcctacctgtgcccttcctacaggggacattgtgacatgtctctgcattcctcacctaggagatgtgactctcatcttctgcttgcaccctgcctacatggaaagctgtggcatattgctgtggtcagcaaccagatgatgtgtttctcctgcctgggtcttaataaagacaggaaagatggttgacatattactgggcccagcatccaggtgatgttttgccttcaggtgacattgtgacatcgctgggccctgcattgacaatttgtgactcttctgcctgtgatttgcacacttgggccattgtgacatattactgggtgtgacactcagggaatgtaatttttatgcctgggccttgcctataggcggcattttgaaatgtctttgtggccgggtgtggtgactcatgcctgtaatcccagtactttgggaggctgagggaagtggatcacaaggtcaggagtacaagaccagcctgcttaatattgtgaaaccctgtctctactaaaaaaagaaaaatacgaaaagcagccagccatggtgactggtgcctgtagtcccagctactcaagaggctgaggcaggagaattggttgaattcgggaggtggaggttgcagtgagccaaaatcgtgccactgcactccagcctgggtgatagagtgagattccatctcaaaaaacaaaaacaaaacaaaaaaaagaatgaatgaatgtctttgcaccaatcccaaaggtgatgtgactctcttgtgttacctggtctctgctcacaggaagaatcgtgacctttcacagcatatggttgatttttttcttttatttcttactttttcctgcaggaaagatggtgaaatattaatgaactaagtaccaaagcgatattacttttttttcttggacctgcctacataatacgttgtgacatattgctgcgccctgcccatagatgatatgagttttctgcccatcaactattttatgtgactctcctcttttatcttcgttttgtccgtaggttagattgcaatatatctttgggcctgggtcatgctaacagaagcgacagtgatttattactgggcacagcccacagggttgtgatattcctgcttgattcctgcccaagtggtcattttgacatatctcttggccagtcgcctaaatgataggtctctccttatctttctgtacctgtccacagtaggaaatgtgacatatctctgggcccagcacctatgtgatgtgaccttcctgtcatgccaaggccttgcctactgtagtgattgtgccatatagctgggcccagctcctatgtatctgactctcattttcttcctgagccctatgaaaagatagcattataacatctttctgagcattttaccaaggtgatgtgacttttcttcctgggttgtcctctcagggcattgtgacatgttgctggatgcagcatttaggtgatgtgacttcctctactgcttggactctgaccaaaaagggatt

SEQ ID NO: 3790 - DNA, 1556 bp, Homo sapiens
atttctgttttcaagaaaatcctggggatttgtctgtttagaaaagaatttcttcaagatatttcatcttgacctgaactttccacattcctgagcggatctgtgtccttcactttagattattggtattactgtctctaagccagacctgatcacctatctggagcaagaaaaagagccctggaatatgaagtgacatgagatggtggatgaacccccaggtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagagatctccataattttgagatactctatgttaaactattttttaagttctctttttacatcacgtctgaaatgcacgagagtggcggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatgtatgttttagggttgtgtttttcattactgtgaaaaaagaacactggaattttgacagggagtttattgaatctagagatcactttggataatatggcagtttcacaatacttattctttcagtagaaataaaatatttttaaatttatttgtgtcctctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgttttttttttatatataagattacatggtctaccaacagcaatgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggccccccaatgtgatagaatgccctctgggtttgtggtgaagaagggttgtagcttggtcttaaggctgctgggtttgcacaagggttcacctttagttgtcttgttaaaaggggcttggataggctgggtgcggtggctcatgcctgtaatcccagcactg

SEQ ID NO: 3791 - DNA, 1509 bp, Homo sapiens
gtctttacctcttgctcccgccagagtttgggatcggtctcttctgttccgcgtcctccacctcggtagcccctggtgactctgttacagcctctgttgacctatgatctgcagggagacgcacagccaggacatcctggaacctgggaaagggtgtgattttggcacacacttctgcccagcaccttagtaatgtaattcttcagaattggcccagcctacaaataggattgtgccacactgctggacccagcgcctaagtgatgtaactctgttctgccttggtgctacttgaaaaagacattgtaatatatctcagagccttacacccaggtaatgtgagtctcctctcatgccttgctgctgcacacagaagcaggatatgcacaggattgttaatctcatcttggaccttcctgcacgtgtgactgtgacagatgcttctgtgtagaacctgagtgattttactctcctgtctggatttaacccacagatgaatcgtgacatatcgctggaccagaaactaggtgatgtgaccccattgtcttgcctctgtgctttccacatggggcatttggacatatcactgtgccttgcacccaggggatgggagttttctctcctgctttggtgccatccacagtgaacattgtgaaatattgctgccctcccccctagtttatgttactctcctgcctctgctttgctcacatgggtcattgtgacagtgtgacatactgctgggtctaaaactcaggtagtgtaactctcttgtttgggttctgcctgcaggagccattgtgacatatctctgtgctcatcacccaggtgatgtgactcccttttactgcctggtttcttctcacaaaacatcttgtgacatattgctaggccccatacctagctggtatgactcttttaggctccacctgctgcagagattgtaacaaactgctgggcccagcagcataatgatattactcttttgccttgggcctgccctcagaaagcactgtaacattcatgggcccaatgccgaggtgatgtgtgtcttcagcctggaccctgcccacagggggcattgtaacatatcacttggctcatcagatgtttgatgttatcccctcccctctcctaccctgtgtttgcctataagagacattgtcacaagtttctgggcccagcacctaggtgatatcttcctgggacctgccatatggggattgtgatatatcgcatggcccagtacttacttgatgtgactctcctctcatgcctgggccctgcttacaggtgtgattgtgacacatagcttggcctagcccctaggttatgttactctcctcttatccttcagttattttcacaaggggcattgtgacatattgctggactgggaacccaggtgatgtgactctcctctactgcctgaaatacaaccaaaaagaaagtttgatatattgcttggccaggatcctaggtgacgttattcttttctcctgcctaaac

SEQ ID NO: 3792 - DNA, 153 bp, Artificial Sequence
  Synthetic oligonucleotide
gtctttacctcttgctcccgccagagtttgggatcggtctcttctgttccgcgtcctccacctcggtagcccctggtgactctgttacagcctctgttgacctatgatctgcagggagacgcacagccaggacatcctggaacctgggaaagg

SEQ ID NO: 3793 - DNA, 374 bp, Artificial Sequence
  Synthetic oligonucleotide
gtgtgattttggcacacacttctgcccagcaccttagtaatgtaattcttcagaattggcccagcctacaaataggattgtgccacactgctggacccagcgcctaagtgatgtaactctgttctgccttggtgctacttgaaaaagacattgtaatatatctcagagccttacacccaggtaatgtgagtctcctctcatgccttgctgctgcacacagaagcaggatatgcacaggattgttaatctcatcttggaccttcctgcacgtgtgactgtgacagatgcttctgtgtagaacctgagtgattttactctcctgtctggatttaacccacagatgaatcgtgacatatcgctggaccagaaactag

SEQ ID NO: 3794 - DNA, 982 bp, Artificial Sequence
  Synthetic oligonucleotide
gtgatgtgaccccattgtcttgcctctgtgctttccacatggggcatttggacatatcactgtgccttgcacccaggggatgggagttttctctcctgctttggtgccatccacagtgaacattgtgaaatattgctgccctcccccctagtttatgttactctcctgcctctgctttgctcacatgggtcattgtgacagtgtgacatactgctgggtctaaaactcaggtagtgtaactctcttgtttgggttctgcctgcaggagccattgtgacatatctctgtgctcatcacccaggtgatgtgactcccttttactgcctggtttcttctcacaaaacatcttgtgacatattgctaggccccatacctagctggtatgactcttttaggctccacctgctgcagagattgtaacaaactgctgggcccagcagcataatgatattactcttttgccttgggcctgccctcagaaagcactgtaacattcatgggcccaatgccgaggtgatgtgtgtcttcagcctggaccctgcccacagggggcattgtaacatatcacttggctcatcagatgtttgatgttatcccctcccctctcctaccctgtgtttgcctataagagacattgtcacaagtttctgggcccagcacctaggtgatatcttcctgggacctgccatatggggattgtgatatatcgcatggcccagtacttacttgatgtgactctcctctcatgcctgggccctgcttacaggtgtgattgtgacacatagcttggcctagcccctaggttatgttactctcctcttatccttcagttattttcacaaggggcattgtgacatattgctggactgggaacccaggtgatgtgactctcctctactgcctgaaatacaaccaaaaagaaagtttgatatattgcttggccaggatcctaggtgacgttattcttttctcctgcctaaac

SEQ ID NO: 3795 - DNA, 962 bp, Artificial Sequence
  Synthetic oligonucleotide
tctccatttttgcctacactctgcccacagaaaaattatcactaggcccaggtaccagacaatgtgtctttcttgcatggccttttaccatagaaagcattgttacctattgctgggctcagcacctaggtgatgtcattgctgcctgtcgtgctttcaggagaaggttgtaacatattcctggctgagtattaaagtgatgtgacactcctgtctggtccctgccctcaggaaagattgtgatgtattcttggccaaaaaacccaggtgatgttaccctcctcctttctgcctgttcacaggtgggattgtaaaatatattttggtctagctcacaggtgcaatggtgactctcatacctcaaaccatctaataggagaggtgctgtcttttatagctaggcctagggtaatgattaagatcctcggtctccttttttgtacaaagtcataggaaattaccactttcttgtatactatacacatctcttgtggtacagtgagtgtcattccagggttcagcacacaggtgagattgtggttctcatgtgcacaccccaccaattgttagaattgtcaccataatacaatccacagttaaaattgtgactgtcatatgtgaacatccagccagagttggaatgatgatttatttctaaatccagtactttagcgggtgaaaattctatctggacccatgaaaaatttacctgggcttagggccagagtaaacacagtttacaggaggaatgaaggctctcatgtgccaatccagttcattggtgaaattgtcagtactgtacttagacccaacatagaaaatgtggtgattctcttacctagaactgggacctgtgcgggattgttaatttattactggaccttcctgcgggagtgattatcacatatgcctatgttcagcacctgagtgatttgattttgctgcctggtcccagtctgaag

SEQ ID NO: 3796 - DNA, 275 bp, Artificial Sequence
  Synthetic oligonucleotide
gctccgcatatttgggtattgtgacatattgctgaactcaacacctaagggatgagagtctcctacctgtgcccttcctacaggggacattgtgacatgtctctgcattcctcacctaggagatgtgactctcatcttctgcttgcaccctgcctacatggaaagctgtggcatattgctgtggtcagcaaccagatgatgtgtttctcctgcctgggtcttaataaagacaggaaagatggttgacatattactgggcccagcatccaggtgat

SEQ ID NO: 3797 - DNA, 1293 bp, Artificial Sequence
  Synthetic oligonucleotide
gttttgccttcaggtgacattgtgacatcgctgggccctgcattgacaatttgtgactcttctgcctgtgatttgcacacttgggccattgtgacatattactgggtgtgacactcagggaatgtaatttttatgcctgggccttgcctataggcggcattttgaaatgtctttgtggccgggtgtggtgactcatgcctgtaatcccagtactttgggaggctgagggaagtggatcacaaggtcaggagtacaagaccagcctgcttaatattgtgaaaccctgtctctactaaaaaaagaaaaatacgaaaagcagccagccatggtgactggtgcctgtagtcccagctactcaagaggctgaggcaggagaattggttgaattcgggaggtggaggttgcagtgagccaaaatcgtgccactgcactccagcctgggtgatagagtgagattccatctcaaaaaacaaaaacaaaacaaaaaaaagaatgaatgaatgtctttgcaccaatcccaaaggtgatgtgactctcttgtgttacctggtctctgctcacaggaagaatcgtgacctttcacagcatatggttgatttttttcttttatttcttactttttcctgcaggaaagatggtgaaatattaatgaactaagtaccaaagcgatattacttttttttcttggacctgcctacataatacgttgtgacatattgctgcgccctgcccatagatgatatgagttttctgcccatcaactattttatgtgactctcctcttttatcttcgttttgtccgtaggttagattgcaatatatctttgggcctgggtcatgctaacagaagcgacagtgatttattactgggcacagcccacagggttgtgatattcctgcttgattcctgcccaagtggtcattttgacatatctcttggccagtcgcctaaatgataggtctctccttatctttctgtacctgtccacagtaggaaatgtgacatatctctgggcccagcacctatgtgatgtgaccttcctgtcatgccaaggccttgcctactgtagtgattgtgccatatagctgggcccagctcctatgtatctgactctcattttcttcctgagccctatgaaaagatagcattataacatctttctgagcattttaccaaggtgatgtgacttttcttcctgggttgtcctctcagggcattgtgacatgttgctggatgcagcatttaggtgatgtgacttcctctactgcttggactctgaccaaaaagggatt

SEQ ID NO: 3798 - DNA, 125 bp, Artificial Sequence
  Synthetic oligonucleotide
atttctgttttcaagaaaatcctggggatttgtctgtttagaaaagaatttcttcaagatatttcatcttgacctgaactttccacattcctgagcggatctgtgtccttcactttagattattg

SEQ ID NO: 3799 - DNA, 1335 bp, Artificial Sequence
  Synthetic oligonucleotide
gtaggttagagtgaatacaacagacaacatggatgagaggcccaaatcaagaagaaagcaagtctttaaagtgatttgggaagctgtgttcaaaaggaaatagtttctggaaagcctgaaatttttaaaaattatactctcacgtaggggcatcttatgtcttatgtttataaaatttctaagaattctaatttcccttcagtgttcttccttcaaatttacagtgacagctaaagtactattcatgacatacaaaaagagtgcacaatctgacttttttcttgtttttgtggacagagagagatctccataattttgagatactctatgttaaactattttttaagttctctttttacatcacgtctgaaatgcacgagagtggcggtttctgtttcactggttttcttgttcattttttctgcacatttcatcctgttttcattaccatagttttgaaatatagtttgaaattataaagtatgatgtccttctgctttgttcttttttcttaagattgctttggctattcaaagtttattgtagtttcatgtatgttttagggttgtgtttttcattactgtgaaaaaagaacactggaattttgacagggagtttattgaatctagagatcactttggataatatggcagtttcacaatacttattctttcagtagaaataaaatatttttaaatttatttgtgtcctctaatttttttcattgatatatctttcacttaaaagatttacaagctccttgtttaaatttgttctaaaattaattatttcattgctattgtaaataagattttttttctctcttttatcagaccgtttgttttaagtgtatggaaccataacttatacttgtatgttaattttatatttttagtttaaacaagttttaatgtactgtttatgttttttttttatatataagattacatggtctaccaacagcaatgttttacttttggtcttcaatttcaatgactttaaatttttcttttgactatttcttcatccacatactttcagtgctatgttaaaatagaagcattgacaataagaaacaattgttttgcaatggggtctgtaaatttaaaggagcaaacacctcttcaagattttataaactggtttcagagagcaaaaataaatttttgtttggccccccaatgtgatagaatgccctctgggtttgtggtgaagaagggttgtagcttggtcttaaggctgctgggtttgcacaagggttcacctttagttgtcttgttaaaaggggcttggataggctgggtgcggtggctcatgcctgtaatcccagcactg

SEQ ID NO: 3800 - DNA, 137 bp, Artificial Sequence
  Synthetic oligonucleotide
cccatgcaacaacaagggagctcactcagtgggtttgatgtggtggatgctggctcgggaagttctgcgcatgcgtggcaccatttcccgtgaacacccatgggaggtcatgcctgatctgtacttctacagagatc

SEQ ID NO: 3801 - DNA, 126 bp, Artificial Sequence
  Synthetic oligonucleotide
ctgaagagattgaaaaagaagagcaggctgctgctgagaaggcagtgaccaaggaggaatttcagggtgaatggactgctcccgctcctgagttcactgctactcagcctgaggttgcagactggt

SEQ ID NO: 3802 - DNA, 3622 bp, Artificial Sequence
  Synthetic oligonucleotide
gtatatgccctcattttgcttaagacctctggccagagcagggcatggaagattccttttaaaaagtaatactgagaagacatgaaaaatgtggacatgataatttactgttgagaaatggctgtaaaagtgtggatgagtgtcaggtgcacaaagaaggttataatggacttaacaagtgtttcacaactactcagagcaaagtatttcaatgtggtaaatgtttgaaagtcctttataaatttttaaattcaaacaaaaaataagatatactggaagaaaacctttcaaatgtcaaaaatgtgtcaaatcattttgcatgctttcacacaaaacccaacataaaagcatttatactagagagaagtcctacaaatgtaaaaaatgtggaaaaacctttaattggtcctcaatccttactaataataagaaaattcatactgaatagaaaccttacaaatgtgaagaatgtggcaaagcttttaagcaacactcaacccttactacacataaaataatttgtgctgaagaaaaactttacagatgtgaagaatgtggcaaagcattttgccagccctcaaccctaactagatataagaggatgcacggaagaaagaaactctacaaatgtgaagaatgtggcaaagcgtttacccagttctcaacccttactaaacataagagaattcatactagagggaaacattacaagtgtgaagaaagtggcaaagcatttatctggtcctcaggccttactgaacataggagagttcatactagacagaaaccctacaaatgtgaagaatgtggcaaagcattaattcaattctcaaccctaactagacataagaggatacacactggagagaaacccaacaaatctatgtggcaaaccttttagccaaaactcaaaccttactatatataagataattcatactgaaaagaaaccctacaaatgtcaagaatgtggcaatgcttttagccagtccccataccttactacacataaggtaattcatactgggagagaccctacaaatgtgaagaaggtggcaaagcatttctatggttcattaccctaactggtcataagaggatgcacactggagagaaaccctacaaatgtgaagaatatgaaaaagcttttagccagtcatcaatccttactcgacataagataattcatactggagagaaaccttacaaatgtgaagaatgtggcaaagctttcagccagtcctcaacccttactacacataagagaattcatactggagagaaaccctacaaatgtgaggaacgtggcaaatcttttaacctgtcttcaagctttactaaacataaggtaattcacagtggagtaaaaccctacaagtgtgaagaatgtggcaaagcctttaggcagtcttcaatttttgctaaccataagagaattcatactggaaagaaaccctacaagtgtgaagaatgtggcaaatcttttaacctgtcttcaagctttactaaacataaggtaattcttactggtttaaaaccctacaaatgggaagaatgtgccaatgccttttcctggtcctcagccctaactaaacataagaaaatttatacttgaaagcaaccctacaaatgggaaaaatttggcaaagcctttaatccttacaacttaatgcacataagataacttatattgaagagaaatattacaagtgtgaataatgtgtcaaagcctataaaaagtcctcaattctttacagacataaggttatttatactggagagaaactttgcaaacctgaaagatgtgccaatgcttttgacaacaacttaagcttttctaaacataaagaaaatcatgctgctgagaatcctagaagtgtgaagaatgtgacaaagcctttaaatgattgtcacacttgattgtaggtaaggtaattcatactggagataactatcagtgtgtacaatgtggccaagcttctaactaatgctcacacgttattgcacaggaaagcatttataagcatttatacttgagaacaaatgtgcaaatataaagtaaaaaagccattaatacctgctcacatcttactcaaaatcagatagttcatatgaaataaaagcataaaagtgtaattactgtccaaagatctattagaaaatatgtctttaaagtgcagaagagtatttactttaaaaaagcactacaaatataaatagggttgtaatacctttacttgtatcagaaatcttattgtacacattttgtgctagaggaaaaccctgaggcagttgttaaaattttgtccaacatcagtgagtttatattgaagaaaaccctgcaaatataataaatttggaaaaacattttttcaaaaactacaaattataaaacaccaaagagtttatactaaaatatatttttgcaggtgcagtaaatatgaaagatatttaatccaaaattgtctatgtaaatatcagaataatccacagtagaaatatctagggccactcaatgtttagacactactgtaaatcagagtgctgcgtataaaaaataatacaaaactatagatagcataaacattatttgtatataactttaaaagaagtagaatattttttggagagttataattacattcaaattatactttttatgaaaatacaggtttttttcgaagtgaataataatgaagttaaactcttaaattacttcatgctcttccatcattcctggtttattcaaatgtgaaagcatgtgactaattgttgctggacaaaatatatgagagattcttgtttattaggtaagcattacttatgaccttttctatggaaaggtaaggacattaaaatgtaaggtgcataatgaaaatttaagtagagaggctctttgtggttaacttataatattttgtgatacatgaggtaggtgttcagagtaatactcttctgcattattatgaaagaaaaatattcttaattttagttaaaattaggttagtaatgttattttattaattgcacttttatggaatactatacggcatatttttaagttataaattatttgtgaaattaacttttcaattccacatttttaacatgttaaatactatcatgaatccattgaaatgttattgtgccactaactttaacctattccatcttacacaagggtgtaggtaacaatacattatttggtaagataatggactgacatcgctagtaatcttttttgccagtaactttaaatggccaataagttaaaaaatattgttcctataggttatatttttattcttattttcacatttaaatgtatttttcttaatttctgtggatatatgtttatatgtttatgccatatatggcatattttaatacaggaatacaaaatatgataatcacattagaggaaatgagatgtccattacctctagcatttattctttgtattacaagcaattcaattctacagtttaagttatttttaatgtacaattaaattgttattgactacagggtcatttttatcatcataatacaaattatatacaaacatgtaaaatccatacatttctgagtccttaataaatatttttataaattttaatat

SEQ ID NO: 3803 - DNA, 114 bp, Artificial Sequence
  Synthetic oligonucleotide
ggactcttgacgtttaggtatgtggccatagaattctctctggaggagtagcagtgcctggacactgcacagcagaatttatagaggaatgttatgaaaacctggccttcctgg

SEQ ID NO: 3804 - DNA, 96 bp, Artificial Sequence
  Synthetic oligonucleotide
gtattactgtctctaagccagacctgatcacctatctggagcaagaaaaagagccctggaatatgaagtgacatgagatggtggatgaacccccag

SEQ ID NO: 3805 - DNA, 75 bp, Artificial Sequence
  Synthetic oligonucleotide
taacaatgctgcagcttttccgtgctacctgcagaggggtccatacggcgttgttctggattcccgtcgtaactt

SEQ ID NO: 3806 - DNA, 93 bp, Artificial Sequence
  Synthetic oligonucleotide
aaagggaaattttcacaatgtccggagcccttgatgtcctgcaaatgaaggaggaggatgtccttaagttccttgcagcaggaacccacttag

SEQ ID NO: 3807 - DNA, 37 bp, Artificial Sequence
  Synthetic oligonucleotide
gtggcaccaatcttgacttccagatggaacagtacat

SEQ ID NO: 3808 - DNA, 20 bp, Artificial Sequence
  Synthetic oligonucleotide
ctataaaaggaaaagtgatg

SEQ ID NO: 3809 - DNA, 4 bp, Artificial Sequence
  Synthetic oligonucleotide
gcat

SEQ ID NO: 3810 - DNA, 65 bp, Artificial Sequence
  Synthetic oligonucleotide
ctatatcataaatctcaagaggacctgggagaagcttctgctggcagctcgtgcaattgttgcca

SEQ ID NO: 3811 - DNA, 37 bp, Artificial Sequence
  Synthetic oligonucleotide
ttgaaaaccctgctgatgtcagtgttatatcctccag

SEQ ID NO: 3812 - DNA, 28 bp, Artificial Sequence
  Synthetic oligonucleotide
gaatactggccagagggctgtgctgaag

SEQ ID NO: 3813 - DNA, 53 bp, Artificial Sequence
  Synthetic oligonucleotide
tttgctgctgccactggagccactccaattgctggccgcttcactcctggaac

SEQ ID NO: 3814 - DNA, 92 bp, Artificial Sequence
  Synthetic oligonucleotide
cttcactaaccagatccaggcagccttccgggagccacggcttcttgtggttactgaccccagggctgaccaccagcctctcacggaggcat

SEQ ID NO: 3815 - DNA, 52 bp, Artificial Sequence
  Synthetic oligonucleotide
cttatgttaacctacctaccattgcgctgtgtaacacagattctcctctgcg

SEQ ID NO: 3816 - DNA, 18 bp, Artificial Sequence
  Synthetic oligonucleotide
ctatgtggacattgccat

SEQ ID NO: 3817 - DNA, 52 bp, Artificial Sequence
  Synthetic oligonucleotide
ctgaaggtgtacaggtgccctctgtgcctattcagcaattccctactgaaga

SEQ ID NO: 3818 - DNA, 32 bp, Artificial Sequence
  Synthetic oligonucleotide
ctggagcgctcagcctgccacggaagactggt

SEQ ID NO: 3819 - DNA, 6 bp, Artificial Sequence
  Synthetic oligonucleotide
ctgcag

SEQ ID NO: 3820 - DNA, 44 bp, Artificial Sequence
  Synthetic oligonucleotide
ctcccactgctcaggccactgaatgggtaggagcaaccactgac

SEQ ID NO: 3821 - DNA, 95 bp, Artificial Sequence
  Synthetic oligonucleotide
tggtcttaagctgttcttgcataggctcttaagcagcatggaaaaatggttgatggaaaataaacatcagtttctaaaaaaaaaaaaaaaaaaaa

SEQ ID NO: 3822 - DNA, 737 bp, Homo sapiens
ggcaaatacgaggatgccagctctgtcttctgcctcgtgtgctcccatttaatcacatctttattccctatctcctgggtgggtactggtgattattacgagagggtgtcagggtaccctaggccctcttcatgccctctcctgccccctctccaaaccccaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 3823 - DNA, 1382 bp, Homo sapiens
ctgtctcctcagtttaagtgatcctcctgcctcagcttccccagtagctgggactacaggtgtgcaccaccatgcccggctaatttttgtatttttagtagagacagtgttcaccatgttggccaggctggtctcaaactcctgacctcaagttatccgcctgtcccagcctcccaaaggattacaggtgtaagccaccacgcccggccccagcctcccctcttgaagcctccatctctgaatcaggggaatgaatgcaggtctcttaggagcatgagtgatcacagaggacttactggaggaggcatttctgagctgggcatggaaggatgagcaggaatgtgcagagacacagatgatgggatgtggagatgataggacagaccccacctacttccccgggggattgtgaagaatgactcccagagaagtgactcattggctccaatcatttattcattcatcaaacatccgggtcacccaagaggcctcacctagtgacaccctagtcctgcagggttagatcagggctgagagagtggcaaggagagggcactgaggagacactgtggaaggaggatgaagggtgttcctggcagagggatcagcctgtgtggaggtcctgagtaaagtgagatactatgggggtcagaggcagtgggtctggtcttagggatgaaaccaagggagctaggaggcaggagcagcccaagccctgccttaggggcctccactcaagcatgtattgagcacctgctgtttgtgggctttgtcgcatcactgtgaagccaactgtaccctcttctcagtgacgaaacaggcttggctcagggctggtgggcgggaccgttgagataacggggaggaagctgaggcaaccccctgctccccacccacccagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 3824 - DNA, 1253 bp, Homo sapiens
ctgtctcctcagtttaagtgatcctcctgcctcagcttccccagtagctgggactacaggtgtgcaccaccatgcccggctaatttttgtatttttagtagagacagtgttcaccatgttggccaggctggtctcaaactcctgacctcaagttatccgcctgtcccagcctcccaaaggattacaggtgtaagccaccacgcccggccccagcctcccctcttgaagcctccatctctgaatcaggggaatgaatgcaggtctcttaggagcatgagtgatcacagaggacttactggaggaggcatttctgagctgggcatggaaggatgagcaggaatgtgcagagacacagatgatgggatgtggagatgataggacagaccccacctacttccccgggggattgtgaagaatgactcccagagaagtgactcattggctccaatcatttattcattcatcaaacatccgggtcacccaagaggcctcacctagtgacaccctagtcctgcagggttagaggcagtgggtctggtcttagggatgaaaccaagggagctaggaggcaggagcagcccaagccctgccttaggggcctccactcaagcatgtattgagcacctgctgtttgtgggctttgtcgcatcactgtgaagccaactgtaccctcttctcagtgacgaaacaggcttggctcagggctggtgggcgggaccgttgagataacggggaggaagctgaggcaaccccctgctccccacccacccagtgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagccctta

SEQ ID NO: 3825 - DNA, 163 bp, Artificial Sequence
  Synthetic oligonucleotide
ggcaaatacgaggatgccagctctgtcttctgcctcgtgtgctcccatttaatcacatctttattccctatctcctgggtgggtactggtgattattacgagagggtgtcagggtaccctaggccctcttcatgccctctcctgccccctctccaaaccccag

SEQ ID NO: 3826 - DNA, 523 bp, Artificial Sequence
  Synthetic oligonucleotide
ctgtctcctcagtttaagtgatcctcctgcctcagcttccccagtagctgggactacaggtgtgcaccaccatgcccggctaatttttgtatttttagtagagacagtgttcaccatgttggccaggctggtctcaaactcctgacctcaagttatccgcctgtcccagcctcccaaaggattacaggtgtaagccaccacgcccggccccagcctcccctcttgaagcctccatctctgaatcaggggaatgaatgcaggtctcttaggagcatgagtgatcacagaggacttactggaggaggcatttctgagctgggcatggaaggatgagcaggaatgtgcagagacacagatgatgggatgtggagatgataggacagaccccacctacttccccgggggattgtgaagaatgactcccagagaagtgactcattggctccaatcatttattcattcatcaaacatccgggtcacccaagaggcctcacctagtgacaccctagtcctgcagggttag

SEQ ID NO: 3827 - DNA, 129 bp, Artificial Sequence
  Synthetic oligonucleotide
atcagggctgagagagtggcaaggagagggcactgaggagacactgtggaaggaggatgaagggtgttcctggcagagggatcagcctgtgtggaggtcctgagtaaagtgagatactatgggggtcag

SEQ ID NO: 3828 - DNA, 249 bp, Artificial Sequence
  Synthetic oligonucleotide
aggcagtgggtctggtcttagggatgaaaccaagggagctaggaggcaggagcagcccaagccctgccttaggggcctccactcaagcatgtattgagcacctgctgtttgtgggctttgtcgcatcactgtgaagccaactgtaccctcttctcagtgacgaaacaggcttggctcagggctggtgggcgggaccgttgagataacggggaggaagctgaggcaaccccctgctccccacccacccag

SEQ ID NO: 3829 - DNA, 293 bp, Artificial Sequence
  Synthetic oligonucleotide
aatcctgctccactaagaatggtgctaaagtaaaactagtttaataagcccttatggatggtgtaattaatttgataagtcagccattcccccttccccaggcctggcaaaacccgctctctactaaaaatacaaaaattagccaggcgcggtggcgggcgcctgtaatcccagctacttgggaggctgaggcaggagaattgcttgaacccggcaggcagaggttgcagtgagccgaaatcgcgccactgtgctccagcctgggcgacaagagcaaaattccatctcaaaat

SEQ ID NO: 3830 - DNA, 39 bp, Artificial Sequence
  Synthetic oligonucleotide
gcctgcgtgttggatgaacttgacatggagctagccttc

SEQ ID NO: 3831 - DNA, 54 bp, Artificial Sequence
  Synthetic oligonucleotide
ctgaccattgtctgcatggaagagtttgaggacatggagagaagtctgccacta

SEQ ID NO: 3832 - DNA, 22 bp, Artificial Sequence
  Synthetic oligonucleotide
tgcctgcagctctacgccccag

SEQ ID NO: 3833 - DNA, 64 bp, Artificial Sequence
  Synthetic oligonucleotide
ggctgtcgccagacactatcatggagtgtgcaatgggggaccgcggcatgcagctcatgcacgc

SEQ ID NO: 3834 - DNA, 39 bp, Artificial Sequence
  Synthetic oligonucleotide
caacgcccagcggacagatgctctccagccaccacacga

SEQ ID NO: 3835 - DNA, 28 bp, Artificial Sequence
  Synthetic oligonucleotide
gtatgtgccctgggtcaccgtcaatggg

SEQ ID NO: 3836 - DNA, 4 bp, Artificial Sequence
  Synthetic oligonucleotide
aaac

SEQ ID NO: 3837 - DNA, 20 bp, Artificial Sequence
  Synthetic oligonucleotide
ccttggaagatcagacccag

SEQ ID NO: 3838 - DNA, 30 bp, Artificial Sequence
  Synthetic oligonucleotide
ctccttacccttgtctgccagttgtaccag

SEQ ID NO: 3839 - DNA, 22 bp, Artificial Sequence
  Synthetic oligonucleotide
ggcaagaagccggatgtctgcc

SEQ ID NO: 3840 - DNA, 4 bp, Artificial Sequence
  Synthetic oligonucleotide
cttc

SEQ ID NO: 3841 - DNA, 9 bp, Artificial Sequence
  Synthetic oligonucleotide
ctcaaccag

SEQ ID NO: 3842 - DNA, 100 bp, Artificial Sequence
  Synthetic oligonucleotide
ctccctcaggagtgtttgcttcaagtgatggccggtgagctgcggagagctcatggaaggcgagtgggaacccggctgcctgcctttttttctgatccag

SEQ ID NO: 3843 - DNA, 85 bp, Artificial Sequence
  Synthetic oligonucleotide
accctcggcacctgctacttaccaactggaaaattttatgcatcccatgaagcccagatacacaaaattccaccccatgatcaag

SEQ ID NO: 3844 - DNA, 5066 bp, Homo sapiens
cctttctagagggtttgtttgagctgcctttgcccttcccccaggtggagccatggcttctctgtgtgctgactgtaacctccagccagaactcaactgggggcgttttactgcccagcagcccctctgcttcaatacttcatgtccagacttggcacagctaagactcagcccgacagacaggctccccatcttctgctctgcgcctcagtacaggcccctgccgtcttccctctagcgttagccagaaacccaggatcttcatctcagcctctgcctcattcctcatggccaaggcatccctgtcctgtgccttgtgcttcgttagctctcatgtccccgctgagcaccagcctccaaccccacccgggctccctccgccccactgacgcccctgtgaatgtggtcaagccgcttctctgatgcaacacgtggcttcccattgcttttggggtaaaaggccagaacccagaatggggcctgaagtcctgcctgaccgcatggcctccttgctgcccccgggaagcccctgtgatccccaggctggaacagacccccactcttatctgagctctttagacctgggttcctctgcttgcgaaacagttttgtcactagcctttaaacacctgtctctcctggacactggccttccgcagcctctgtccccctctgcccagtccctttcctggcaccttgcctacaccaatagttagtgatgggtgttgagtcgctaaagggaagctggtggtctttcagagtagaattggaaagctcttcatgaggatatttacctgtggtgctatgtgtttactgctattaatccagattttaactataaatccttaggtccatgaatttccccaaccgcttgaaatcacaggaaatagttatttgatagatgtactgcccagtatggcacccaccagccctctctggatgatatttaaattagttgaaagtgaaataaaatttaaaatccatttcctcagccttactggccacatcccagctgttcagtagcccggtgtggctagtggctggcctaggacagcaggcagagaactttccatggtcaccggaagttctgtcgagcagtgctgggcttgagcgtctcaacttccaggctcagaggccatggaaagctggaggtggtgcagaatctgcctttcctcactccatggccccaggcagtttcccattctaggggttctctgggttactaagaaccacgggcagccgtagatggctccagtgggtgcacccttgaagcaatggggatttttactgtacaacttactcgaagtgatgccaaaaccatccttgagaggaaaatgcactccttcctgaaaatcctgattgagatttacttgtttgacttttagattcaaaaagcggtgaggtcgatgccacgtcagaccaggaagagtcagttgcttgggccttagcagtaagtgctgcctttagtaatgaatggacagagggggcgcttgggggctcaggggtccatcaaagcccatgtggcctgaggcgggcagcgctgcctgcacttttctggaagtcctctcctgaggctggcttttgctacttccaagtctcggatttcctcgtgtcgattcccttcagcggtaaggccctcctctcagtctagcacctggcagccagttctacccccagtgcaagcctgattcacgatgattttcactctgcagataaagctgtcagtgtggttggcagggcgccatctgcctggatgagcacacgacaggaaagctgggctctcggtcagtctcccctacaggggcagggtaaaaagagaggtgttctagggagtatttccaggtctgtcctcaaatgccccaagtcacaaggtcgcctcattgggcagccgtcactaacccaaacagtaagtgtcatctatatgtctgtttcccagagtgccccctgggtcacagaaaccacccgttttcttatgggatgtgcttcttatcctccttggttgggatagatgcgaatttacacagagcttaaccagctccagcatctttcctggcccccgtgtcacactctgttgcctgccagaatacctgatgcatggttttcctctaaaattgctacttttgtgcagagggtttcccacgcacccatgtgtgactttcagtgactaagaaaaaggccgtggtcctggggaagaaagtggatgctcactgagagattgtgtagggattggaacaaaggggaagtgggtggtaccaagagtcaagaaccaaagtgccagccccactcagcagaggatagagggtgacgccctctatttccagtgtctagcaggggaggggtaggagagcctcctgagctggagcactgaatttctgtttttgtttttggttcttttgagatggagtttcactctgtcacccaggctggagtgcggtggggcaatctcagctcactgcaacctctacttcctgggttcaagcgattctcctgcctcagcctcccaagtagctgggactacaggcgcccaccaccatgcccagctaatttttgtattgtagtagagatggactttcaccatgttggccaggctggtctcgaactcctggcctcaagtgatccacctgcctcagcctcctaaagtgctgggattacaggcatgacccatcacacccagccaggagcactgaatttcttataaacttaccagtttgaagttattaccagtagttgagtcctgaactcacctatgaatattcagattttttttttcctggtctagcaatgctgtcataaacttctctagacatggtttttttgtgtgtgtgtgtctttttacattcttttggattattaacatagcaggaagtgaaaaagtgactttgaataacatcatggaggtgaaagtgactttgagtaggatcatgtaaagatttgtacattaatgagcttgccagtttgttccagaagccaaaaggtcagctatactcagaagctcttaaaaattctgacttctcttttttgatcagcctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactgcaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattaga

SEQ ID NO: 3845 - DNA, 2785 bp, Homo sapiens
tagagcaggctctggagagctgaagcaggcctgaccaggagtgtggccgcccgaccacctctgcccaccaggtatgagctcctggtcaggacaagcagctgcctctgtgcgttagcttgggcttaaactggctcctccccgccttaaatactccagcatattctttaaagatcacaggaagttgcccaggggccacttgcctatttctctgttctcgctgatgacctcaggacaattttgttctgtttcaatttggctttttgtttgccccagtccctgtcatccctgggccactgttaggaggtgtgagcttatctgctcgtgcctgggcccctgactttccctgctccttccaagtggctttttaagtagcagcccccgctgcaacccaggggagcctcagctccttcctacgctcttgaggcctcttataaagtggacatgcagggagaagagaagccttgtggcaggctcttgctgtctcctgtgttaacagaaggattgcagttttattattttgcggtgactttgaaatgtgctgtcactcaaacaaccatgtttttattggcttctgcacttggaggactcctccatgaagcccgcggacaggacagatggctccgtgcaagctgcagcctggggtcctgagcttccctcgcaccgcacagtcctgggagccgattcaaaaagcggtgaggtcgatgccacgtcagaccaggaagagtcagttgcttgggccttagcacctgcagtgcctcaaagccctttgaaaaatgaattaagaaggaaatacttgacccaagtggatatactgctacaaggtgcagagtattttgagtgtgcaggtaacagagctggaagggatgtacgtgtgactccgctgccttcactggcctcacctgccgtgcctgcccccggatactgcagtcgtatctccggaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactgcaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattaga

SEQ ID NO: 3846 - DNA, 955 bp, Homo sapiens
cctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaagtacaaccagcccttcgaggacaccccggtggtgcaaatggccacgctgacctacgagacgccacagggattgagaatttggggtggaagactaataaaggaaagaaacgaaggagagatccaggtatttagtgtcaaattttattgccaaataaccttgctgtggaggagtattcatatgaataaaggtgtgggtatgcccaacctctgagcttacgcagaggccaccacggggcactttttctcatgattatactctttctgtttttaaggatttagaagcatttcttctgtagcttgtcaagtgcaaggagtcactgtgtaatatttggcctttttcatcaccctgtgtttcctgtgtcacaggctgaggggctctgataatacatgtgcagaggctgggccagttgggtaaccctccccaaggtcacgtgccagcccagcgaggcactcactttgtttgggtccttacagaaaataccaaatccagttccttctagggaagaagaatgtctctcttcctgttttgaaaggggaggaagagagatgaggagaggtgcagcctggaggatcacacatctttccttctgcatttttctaccttcggaagaccctggcttccctgcctagttgatccgagggtgttgtcgctctgagacccgttattttagtggaaggtgctgttggcctttctacgggggcatccaggagcccttttgccacagtggcttttgccaggttatctggtattcagttaatcactgcctctcag

SEQ ID NO: 3847 - DNA, 184 bp, Artificial Sequence
  Synthetic oligonucleotide
cctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgatagagaag

SEQ ID NO: 3848 - DNA, 648 bp, Artificial Sequence
  Synthetic oligonucleotide
gtatttagtgtcaaattttattgccaaataaccttgctgtggaggagtattcatatgaataaaggtgtgggtatgcccaacctctgagcttacgcagaggccaccacggggcactttttctcatgattatactctttctgtttttaaggatttagaagcatttcttctgtagcttgtcaagtgcaaggagtcactgtgtaatatttggcctttttcatcaccctgtgtttcctgtgtcacaggctgaggggctctgataatacatgtgcagaggctgggccagttgggtaaccctccccaaggtcacgtgccagcccagcgaggcactcactttgtttgggtccttacagaaaataccaaatccagttccttctagggaagaagaatgtctctcttcctgttttgaaaggggaggaagagagatgaggagaggtgcagcctggaggatcacacatctttccttctgcatttttctaccttcggaagaccctggcttccctgcctagttgatccgagggtgttgtcgctctgagacccgttattttagtggaaggtgctgttggcctttctacgggggcatccaggagcccttttgccacagtggcttttgccaggttatctggtattcagttaatcactgcctctcag

SEQ ID NO: 3849 - DNA, 583 bp, Artificial Sequence
  Synthetic oligonucleotide
tagagcaggctctggagagctgaagcaggcctgaccaggagtgtggccgcccgaccacctctgcccaccaggtatgagctcctggtcaggacaagcagctgcctctgtgcgttagcttgggcttaaactggctcctccccgccttaaatactccagcatattctttaaagatcacaggaagttgcccaggggccacttgcctatttctctgttctcgctgatgacctcaggacaattttgttctgtttcaatttggctttttgtttgccccagtccctgtcatccctgggccactgttaggaggtgtgagcttatctgctcgtgcctgggcccctgactttccctgctccttccaagtggctttttaagtagcagcccccgctgcaacccaggggagcctcagctccttcctacgctcttgaggcctcttataaagtggacatgcagggagaagagaagccttgtggcaggctcttgctgtctcctgtgttaacagaaggattgcagttttattattttgcggtgactttgaaatgtgctgtcactcaaacaaccatgtttttattggcttctgcacttggag

SEQ ID NO: 3850 - DNA, 1385 bp, Artificial Sequence
  Synthetic oligonucleotide
cctttctagagggtttgtttgagctgcctttgcccttcccccaggtggagccatggcttctctgtgtgctgactgtaacctccagccagaactcaactgggggcgttttactgcccagcagcccctctgcttcaatacttcatgtccagacttggcacagctaagactcagcccgacagacaggctccccatcttctgctctgcgcctcagtacaggcccctgccgtcttccctctagcgttagccagaaacccaggatcttcatctcagcctctgcctcattcctcatggccaaggcatccctgtcctgtgccttgtgcttcgttagctctcatgtccccgctgagcaccagcctccaaccccacccgggctccctccgccccactgacgcccctgtgaatgtggtcaagccgcttctctgatgcaacacgtggcttcccattgcttttggggtaaaaggccagaacccagaatggggcctgaagtcctgcctgaccgcatggcctccttgctgcccccgggaagcccctgtgatccccaggctggaacagacccccactcttatctgagctctttagacctgggttcctctgcttgcgaaacagttttgtcactagcctttaaacacctgtctctcctggacactggccttccgcagcctctgtccccctctgcccagtccctttcctggcaccttgcctacaccaatagttagtgatgggtgttgagtcgctaaagggaagctggtggtctttcagagtagaattggaaagctcttcatgaggatatttacctgtggtgctatgtgtttactgctattaatccagattttaactataaatccttaggtccatgaatttccccaaccgcttgaaatcacaggaaatagttatttgatagatgtactgcccagtatggcacccaccagccctctctggatgatatttaaattagttgaaagtgaaataaaatttaaaatccatttcctcagccttactggccacatcccagctgttcagtagcccggtgtggctagtggctggcctaggacagcaggcagagaactttccatggtcaccggaagttctgtcgagcagtgctgggcttgagcgtctcaacttccaggctcagaggccatggaaagctggaggtggtgcagaatctgcctttcctcactccatggccccaggcagtttcccattctaggggttctctgggttactaagaaccacgggcagccgtagatggctccagtgggtgcacccttgaagcaatggggatttttactgtacaacttactcgaagtgatgccaaaaccatccttgagaggaaaatgcactccttcctgaaaatcctgattgagatttacttgtttgacttttag

SEQ ID NO: 3851 - DNA, 1576 bp, Artificial Sequence
  Synthetic oligonucleotide
gtaagtgctgcctttagtaatgaatggacagagggggcgcttgggggctcaggggtccatcaaagcccatgtggcctgaggcgggcagcgctgcctgcacttttctggaagtcctctcctgaggctggcttttgctacttccaagtctcggatttcctcgtgtcgattcccttcagcggtaaggccctcctctcagtctagcacctggcagccagttctacccccagtgcaagcctgattcacgatgattttcactctgcagataaagctgtcagtgtggttggcagggcgccatctgcctggatgagcacacgacaggaaagctgggctctcggtcagtctcccctacaggggcagggtaaaaagagaggtgttctagggagtatttccaggtctgtcctcaaatgccccaagtcacaaggtcgcctcattgggcagccgtcactaacccaaacagtaagtgtcatctatatgtctgtttcccagagtgccccctgggtcacagaaaccacccgttttcttatgggatgtgcttcttatcctccttggttgggatagatgcgaatttacacagagcttaaccagctccagcatctttcctggcccccgtgtcacactctgttgcctgccagaatacctgatgcatggttttcctctaaaattgctacttttgtgcagagggtttcccacgcacccatgtgtgactttcagtgactaagaaaaaggccgtggtcctggggaagaaagtggatgctcactgagagattgtgtagggattggaacaaaggggaagtgggtggtaccaagagtcaagaaccaaagtgccagccccactcagcagaggatagagggtgacgccctctatttccagtgtctagcaggggaggggtaggagagcctcctgagctggagcactgaatttctgtttttgtttttggttcttttgagatggagtttcactctgtcacccaggctggagtgcggtggggcaatctcagctcactgcaacctctacttcctgggttcaagcgattctcctgcctcagcctcccaagtagctgggactacaggcgcccaccaccatgcccagctaatttttgtattgtagtagagatggactttcaccatgttggccaggctggtctcgaactcctggcctcaagtgatccacctgcctcagcctcctaaagtgctgggattacaggcatgacccatcacacccagccaggagcactgaatttcttataaacttaccagtttgaagttattaccagtagttgagtcctgaactcacctatgaatattcagattttttttttcctggtctagcaatgctgtcataaacttctctagacatggtttttttgtgtgtgtgtgtctttttacattcttttggattattaacatagcaggaagtgaaaaagtgactttgaataacatcatggaggtgaaagtgactttgagtaggatcatgtaaagatttgtacattaatgagcttgccagtttgttccagaagccaaaaggtcagctatactcagaagctcttaaaaattctgacttctcttttttgatcag

SEQ ID NO: 3852 - DNA, 947 bp, Artificial Sequence
  Synthetic oligonucleotide
gaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactgcaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcag

SEQ ID NO: 3853 - DNA, 536 bp, Artificial Sequence
  Synthetic oligonucleotide
ggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagag

SEQ ID NO: 3854 - DNA, 363 bp, Artificial Sequence
  Synthetic oligonucleotide
aggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgttttttttgggggggggttatttgtttgtttgtttgtttgtttgttt

SEQ ID NO: 3855 - DNA, 67 bp, Artificial Sequence
  Synthetic oligonucleotide
tacaaccagcccttcgaggacaccccggtggtgcaaatggccacgctgacctacgagacgccacagg

SEQ ID NO: 3856 - DNA, 56 bp, Artificial Sequence
  Synthetic oligonucleotide
gattgagaatttggggtggaagactaataaaggaaagaaacgaaggagagatccag

SEQ ID NO: 3857 - DNA, 97 bp, Artificial Sequence
  Synthetic oligonucleotide
gactcctccatgaagcccgcggacaggacagatggctccgtgcaagctgcagcctggggtcctgagcttccctcgcaccgcacagtcctgggagccg

SEQ ID NO: 3858 - DNA, 65 bp, Artificial Sequence
  Synthetic oligonucleotide
attcaaaaagcggtgaggtcgatgccacgtcagaccaggaagagtcagttgcttgggccttagca

SEQ ID NO: 3859 - DNA, 93 bp, Artificial Sequence
  Synthetic oligonucleotide
cctgcagtgcctcaaagccctttgaaaaatgaattaagaaggaaatacttgacccaagtggatatactgctacaaggtgcagagtattttgag

SEQ ID NO: 3860 - DNA, 79 bp, Artificial Sequence
  Synthetic oligonucleotide
tgtgcaggtaacagagctggaagggatgtacgtgtgactccgctgccttcactggcctcacctgccgtgcctgcccccg

SEQ ID NO: 3861 - DNA, 114 bp, Artificial Sequence
  Synthetic oligonucleotide
gatactgcagtcgtatctccggaaagagtcctggtgacccagcgaaaccagcttcatctcccagagaatgggatcctttgcatccttcctccacagacatggccttagtaccta

SEQ ID NO: 3862 - DNA, 7232 bp, Homo sapiens
tgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcaggtgagtgacccgccgcgactcggcgggaacgcgcgctgtgggactggcaggcaaacgcgcccagcccgaggctggctggggttgttgagcgcggagttgacatctgaaggtccggtgtcggtccggtagaggctcaggaaagccatttggcaactttgagataggattcccgtgcaattttggtgtaacggcgctggaagggatgggggcgagcaaacgggttcagttgtgaatttttgtttgtgacctgtggaatggtacaggtcacaaacaaaaattcaatatctttattgtattcccgctaaaatcgagacggtcaatcaagagagcaagtggacttttttcccagagacaatcaatatgactatgtgagcatgatgaaaagttttttgaccctaacctcacctccgtggtgttagattgccgttaaagagaagacgataatttatttgaagccactgtagcttttgtgagtccaggagttgggtgacattattaaaccctcgtggcagtgtcgctgaagttcatgagtttccaaaatgaaggttccaggtgctcagcggtacggagaattgcatctagagccttaggatttaacctcctgtttaggataggcagcaggaaatagcttgttacggttttcccagatttgctctatgatgtagtgttttgactcttaagaggtataggtgtatagaattttgtgaccggtggcatttctttcaagaatttcttttttagtaaaaccaagctgaaggtttagtcacccccgtgagtttaagataataacatatttaagtggaaaatatagactcctaagtttcataaataacatccctccatcccctactttaaagatgggcagtcattagttctccgaactaattgcactaatgtaggcttttcccccgccgtttgccttcgttttcctttcctttcactgacttagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3863 - DNA, 5499 bp, Homo sapiens
tgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggtatgagttgctttgtattgaagaggagatgggatgatactggaaccaatttaaagagctggatatatgacagtgcctagaatgtagtaagcactcatagacttaaagttttataactatcaatttttatttgtacaataagaatactataatttgtgaatttaaatgcttaaattattttaaaatggaaggggcatgaggagagattggtaattccttcatctctgtaatgtgaaaatgatggctctatttggaaaattctatctagcagttcttttcggtgtttaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3864 - DNA, 7179 bp, Homo sapiens
tgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcaggtgagtgacccgccgcgactcggcgggaacgcgcgctgtgggactggcaggcaaacgcgcccagcccgaggctggctggggttgttgagcgcggagttgacatctgaaggtccggtgtcggtccggtagaggctcaggaaagccatttggcaactttgagataggattcccgtgcaattttggtgtaacggcgctggaagggatgggggcgagcaaacgggttcagttgtgaatttttgtttgtgacctgtggaatggtacaggtcacaaacaaaaattcaatatctttattgtattcccgctaaaatcgagacggtcaatcaagagagcaagtggacttttttcccagagacaatcaatatgactatgtgagcatgatgaaaagttttttgaccctaacctcacctccgtggtgttagattgccgttaaagagaagacgataatttatttgaagccactgtagcttttgtgagtccaggagttgggtgacattattaaaccctcgtggcagtgtcgctgaagttcatgagtttccaaaatgaaggttccaggtgctcagcggtacggagaattgcatctagagccttaggatttaacctcctgtttaggataggcagcaggaaatagcttgttacggttttcccagatttgctctatgatgtagtgttttgactcttaagaggtataggtgtatagaattttgtgaccggtggcatttctttcaagaatttcttttttagtaaaaccaagctgaaggtttagtcacccccgtgagtttaagataataacatatttaagtggaaaatatagactcctaagtttcataaataacatccctccatcccctactttaaagatgggcagtcattagttctccgaactaattgcactaatgtaggcttttcccccgccgtttgccttcgttttcctttcctttcactgacttagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3865 - DNA, 4620 bp, Homo sapiens
ttttaaaaagctgcagctttttaatctgtcaacatgttaataatttgtgtgggttttggatatggtgggaatcttgtctacgtcttctcaatcataaacgtttttaggcttgtttggaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3866 - DNA, 5162 bp, Homo sapiens
tcagccttgatggttacttattatggattttttttctctttactcttcataattaaactgcataaatgcaaatatgtaaagttaatctaagattttaattacagttcaaagttgttatattagtgattacaaactgaaagttttctgatgtcttatgtaccagtgccattagttttctctagtcaaggtggtctgtttgatttctgttattaccatgagaaataggtaatatccttttctgtcaaaggctcttgtttttagaaaactgaacatgtaagtttttgactacctttgaaacccattacttgttaaggaactcctaaaaaccatgtttgtagagaaagttggtaatactactttgggacagggttcctaacacagtttaaccatgcaagtgtttttgaaaattctttgttttagaacaggagcttcaattgtgttattaacaattgataatgtttccactataatcagattgcagattaagtgaaagctttcctaaattttacttaaagaaacaagttttatttatttatattgaacattctagttggggaaatgagtgtgtgtaagtgggtgtatattacacttttataaggatttatctaagggaatataaattcatgtttcatatctccctgtgtaaaattaaaactcttaggaataccagtgaaaataacatttttatttataccttattaaatcattgcactactaactgtacattatttagatgtttattactcttggctttattatttaactgctcccaattctcacttaagattgatttagctaaacatacacagtgagtatgaaatataacttttttttaaagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3867 - DNA, 4105 bp, Homo sapiens
acatgttctaatgtcaaactataaaacttaacaggttagaatacctgtgtgatgaagtgtcacttaatagagtctgctttggaatatggacatgttctaatgtcagattataaaactttacaggttagaatacctgtgtgataaagtgtcaatggataatgcagtagctttcatgatgggatacttcatagttagtggattttcactgtttgcttatttaatatatattgagtactcatgtgccctgcaccccatgttaatgacaaagctaggcctcaaatgtctttattcctcagcgtaatgatcgatctcacaaagctcttgtgaaatcagttgggaaaagactatgtacagtgaatattgacaactaggcaaaaactgaatctagtccacttgtgagaatttcttatttctatatactgtgcttatagaatctcctttcttaaatcgaatataaaatgtatggtttcatttcagtgtaggtttgaaagtaaatatctgtccagatttaatgaactcatattttaacagagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3868 - DNA, 3697 bp, Homo sapiens
tcattagggcagagctgaagaattagggcacacttatgtataactatgtagtatcaaactgggatttccacagccccagctatacttctctatcaggatgaactgtttgctcctgaaaaaaatattacacctaatgttttcttttattgacccaagtaatttatgccccttttaaacccatccatattttccacaaccaaaccagcaattgccatacaggtgctcagttttggttcaaatttttattgttggtctttctttctttattgttattaaagcattacaactaattcagtgctatgactggtcatatttagaagttaatgcttctggatttcattttattttcacttttagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3869 - DNA, 2791 bp, Homo sapiens
gtctttgaacactagggtggtctacataagtttgctaccttgtaaacagaaatgtggcattttaacgtgtctttataatgagcttacatattttgtgtttgttggccattttcattttttatatcaatggcacatatctttcctcttcctattagtgtgtgtctttttcttgaagattttaagtgccctttttaaaaattcacaatgtttaaagcaaatgttaaaatattgaccttaaatgttaaaacttttttgtagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3870 - DNA, 2325 bp, Homo sapiens
ttaccgtttagtttaattttaaacatattctttatgaaaaaggagggtttggggaggattgttttagggggttggggttcttaaattttgtttgtgagctacattgtgatttttaattctgtgatcacttctaaggtttataggggacataacaatataaattgttatatacagaaaagtctgagtaacgattagaattagacaactaccctttcaccctagggctgatctggacatttaagaaaagattacatggacacttttgagtgttacaactatttttcttgaagtcctttgaaaaataattgataaatcagtcacaactcctgttgttttcatagctgtgtaatttgtcatatttttttttaaacaatgaattgtatgtaatattatgccttctctaactctcccctaaattgaacttttagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaa

SEQ ID NO: 3871 - DNA, 1849 bp, Homo sapiens
tgataatcgccgcactttttttcaaattagtggatcccagaaatcattgcgcgcatttgtaacgaatttccgttcgagtttgtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaagtaagttttttttttttatcagtgtttattttggtggcttttttttttttaacttaaagattattttttcaaaaatactgaaacctgaactggtaagtttggacttttaatgtccaacattcctaaaactagtcaacctagacttagatgactattcttttaattcctgctgacatgttttttaaaaagtttactaaatgagagtttgtagt

SEQ ID NO: 3872 - DNA, 129 bp, Artificial Sequence
  Synthetic oligonucleotide
tgataatcgccgcactttttttcaaattagtggatcccagaaatcattgcgcgcatttgtaacgaatttccgttcgagtttgtattttaggcgccattttcgagtgaaggacccggagccgaaacaccg

SEQ ID NO: 3873 - DNA, 850 bp, Artificial Sequence
  Synthetic oligonucleotide
gtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcacccctcccccctcggccgctccccggcggcccgggctcccgcgcgcagctcccgggcgccacttttccaagctactcaaatgtctcggggaggccctgagcctcgcagatcttttctttaaaaaatcctagtctctatctggaaaagggcgtctccccctacccctcttccttctgccaacggactagtcaccgggtctcagccttcgctggtgacctttcatggtttactgtccaacgggactccgcctggggagctggagagacaaactcttgccactccaaaattagcaagcgctgccagcgtccgacttgaagttgctagtggttagtcccagccttcgcccttcgcggtccgaccgctgagaggagggagacttcgttatgccccgggccgtcaacggcgccaggagctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcag

SEQ ID NO: 3874 - DNA, 194 bp, Artificial Sequence
  Synthetic oligonucleotide
gtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccag

SEQ ID NO: 3875 - DNA, 144 bp, Artificial Sequence
  Synthetic oligonucleotide
cgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcag

SEQ ID NO: 3876 - DNA, 949 bp, Artificial Sequence
  Synthetic oligonucleotide
gtgagtgacccgccgcgactcggcgggaacgcgcgctgtgggactggcaggcaaacgcgcccagcccgaggctggctggggttgttgagcgcggagttgacatctgaaggtccggtgtcggtccggtagaggctcaggaaagccatttggcaactttgagataggattcccgtgcaattttggtgtaacggcgctggaagggatgggggcgagcaaacgggttcagttgtgaatttttgtttgtgacctgtggaatggtacaggtcacaaacaaaaattcaatatctttattgtattcccgctaaaatcgagacggtcaatcaagagagcaagtggacttttttcccagagacaatcaatatgactatgtgagcatgatgaaaagttttttgaccctaacctcacctccgtggtgttagattgccgttaaagagaagacgataatttatttgaagccactgtagcttttgtgagtccaggagttgggtgacattattaaaccctcgtggcagtgtcgctgaagttcatgagtttccaaaatgaaggttccaggtgctcagcggtacggagaattgcatctagagccttaggatttaacctcctgtttaggataggcagcaggaaatagcttgttacggttttcccagatttgctctatgatgtagtgttttgactcttaagaggtataggtgtatagaattttgtgaccggtggcatttctttcaagaatttcttttttagtaaaaccaagctgaaggtttagtcacccccgtgagtttaagataataacatatttaagtggaaaatatagactcctaagtttcataaataacatccctccatcccctactttaaagatgggcagtcattagttctccgaactaattgcactaatgtaggcttttcccccgccgtttgccttcgttttcctttcctttcactgacttag

SEQ ID NO: 3877 - DNA, 171 bp, Artificial Sequence
  Synthetic oligonucleotide
cgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcat

SEQ ID NO: 3878 - DNA, 127 bp, Artificial Sequence
  Synthetic oligonucleotide
aacggcctgcagagataatacttctgtctatcacataagtggaaagaaaaagacatttaaggatgttggaaatcttcttcgaagccatggaattgacttggaccataatagatttttaattttacag

SEQ ID NO: 3879 - DNA, 838 bp, Artificial Sequence
  Synthetic oligonucleotide
tcagccttgatggttacttattatggattttttttctctttactcttcataattaaactgcataaatgcaaatatgtaaagttaatctaagattttaattacagttcaaagttgttatattagtgattacaaactgaaagttttctgatgtcttatgtaccagtgccattagttttctctagtcaaggtggtctgtttgatttctgttattaccatgagaaataggtaatatccttttctgtcaaaggctcttgtttttagaaaactgaacatgtaagtttttgactacctttgaaacccattacttgttaaggaactcctaaaaaccatgtttgtagagaaagttggtaatactactttgggacagggttcctaacacagtttaaccatgcaagtgtttttgaaaattctttgttttagaacaggagcttcaattgtgttattaacaattgataatgtttccactataatcagattgcagattaagtgaaagctttcctaaattttacttaaagaaacaagttttatttatttatattgaacattctagttggggaaatgagtgtgtgtaagtgggtgtatattacacttttataaggatttatctaagggaatataaattcatgtttcatatctccctgtgtaaaattaaaactcttaggaataccagtgaaaataacatttttatttataccttattaaatcattgcactactaactgtacattatttagatgtttattactcttggctttattatttaactgctcccaattctcacttaagattgatttagctaaacatacacagtgagtatgaaatataacttttttttaaag

SEQ ID NO: 3880 - DNA, 128 bp, Artificial Sequence
  Synthetic oligonucleotide
ttaaacagggtaaagatggtggaaaaggaaaaggatgccttagaaggagagaaaaacatagctatcgaatttcttaccttggaaaatgaaatatttagaaaaaagaatcatgtttgtcaatattatat

SEQ ID NO: 3881 - DNA, 141 bp, Artificial Sequence
  Synthetic oligonucleotide
ttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaa

SEQ ID NO: 3882 - DNA, 151 bp, Artificial Sequence
  Synthetic oligonucleotide
gaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaag

SEQ ID NO: 3883 - DNA, 165 bp, Artificial Sequence
  Synthetic oligonucleotide
gttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaa

SEQ ID NO: 3884 - DNA, 212 bp, Artificial Sequence
  Synthetic oligonucleotide
gtaagttttttttttttatcagtgtttattttggtggcttttttttttttaacttaaagattattttttcaaaaatactgaaacctgaactggtaagtttggacttttaatgtccaacattcctaaaactagtcaacctagacttagatgactattcttttaattcctgctgacatgttttttaaaaagtttactaaatgagagtttgtagt

SEQ ID NO: 3885 - DNA, 531 bp, Artificial Sequence
  Synthetic oligonucleotide
acatgttctaatgtcaaactataaaacttaacaggttagaatacctgtgtgatgaagtgtcacttaatagagtctgctttggaatatggacatgttctaatgtcagattataaaactttacaggttagaatacctgtgtgataaagtgtcaatggataatgcagtagctttcatgatgggatacttcatagttagtggattttcactgtttgcttatttaatatatattgagtactcatgtgccctgcaccccatgttaatgacaaagctaggcctcaaatgtctttattcctcagcgtaatgatcgatctcacaaagctcttgtgaaatcagttgggaaaagactatgtacagtgaatattgacaactaggcaaaaactgaatctagtccacttgtgagaatttcttatttctatatactgtgcttatagaatctcctttcttaaatcgaatataaaatgtatggtttcatttcagtgtaggtttgaaagtaaatatctgtccagatttaatgaactcatattttaacag

SEQ ID NO: 3886 - DNA, 234 bp, Artificial Sequence
  Synthetic oligonucleotide
agtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggag

SEQ ID NO: 3887 - DNA, 357 bp, Artificial Sequence
  Synthetic oligonucleotide
tcattagggcagagctgaagaattagggcacacttatgtataactatgtagtatcaaactgggatttccacagccccagctatacttctctatcaggatgaactgtttgctcctgaaaaaaatattacacctaatgttttcttttattgacccaagtaatttatgccccttttaaacccatccatattttccacaaccaaaccagcaattgccatacaggtgctcagttttggttcaaatttttattgttggtctttctttctttattgttattaaagcattacaactaattcagtgctatgactggtcatatttagaagttaatgcttctggatttcattttattttcacttttag

SEQ ID NO: 3888 - DNA, 186 bp, Artificial Sequence
  Synthetic oligonucleotide
aaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattg

SEQ ID NO: 3889 - DNA, 162 bp, Artificial Sequence
  Synthetic oligonucleotide
ggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataag

SEQ ID NO: 3890 - DNA, 226 bp, Artificial Sequence
  Synthetic oligonucleotide
atggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcag

SEQ ID NO: 3891 - DNA, 153 bp, Artificial Sequence
  Synthetic oligonucleotide
gtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccag

SEQ ID NO: 3892 - DNA, 258 bp, Artificial Sequence
  Synthetic oligonucleotide
gtctttgaacactagggtggtctacataagtttgctaccttgtaaacagaaatgtggcattttaacgtgtctttataatgagcttacatattttgtgtttgttggccattttcattttttatatcaatggcacatatctttcctcttcctattagtgtgtgtctttttcttgaagattttaagtgccctttttaaaaattcacaatgtttaaagcaaatgttaaaatattgaccttaaatgttaaaacttttttgtag

SEQ ID NO: 3893 - DNA, 127 bp, Artificial Sequence
  Synthetic oligonucleotide
cgtttaatagagcaagaagaatatttgaatgtccaagttaaggaacttgaagctaatgtacttgctacagcccctgacaaaaaaaagcagaaattgctagaagaaaacgttagtgctttcaaaacag

SEQ ID NO: 3894 - DNA, 190 bp, Artificial Sequence
  Synthetic oligonucleotide
aatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacag

SEQ ID NO: 3895 - DNA, 145 bp, Artificial Sequence
  Synthetic oligonucleotide
aaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagag

SEQ ID NO: 3896 - DNA, 288 bp, Artificial Sequence
  Synthetic oligonucleotide
gtatgagttgctttgtattgaagaggagatgggatgatactggaaccaatttaaagagctggatatatgacagtgcctagaatgtagtaagcactcatagacttaaagttttataactatcaatttttatttgtacaataagaatactataatttgtgaatttaaatgcttaaattattttaaaatggaaggggcatgaggagagattggtaattccttcatctctgtaatgtgaaaatgatggctctatttggaaaattctatctagcagttcttttcggtgtttag

SEQ ID NO: 3897 - DNA, 127 bp, Artificial Sequence
  Synthetic oligonucleotide
gaatccttaccagagatccagaaagaacatcgcaatctgcttcaagaattaaaagttattcaagaaaatgaacatgctcttcaaaaagatgcacttagtattaagttgaaacttgaacaaatagatg

SEQ ID NO: 3898 - DNA, 428 bp, Artificial Sequence
  Synthetic oligonucleotide
ttaccgtttagtttaattttaaacatattctttatgaaaaaggagggtttggggaggattgttttagggggttggggttcttaaattttgtttgtgagctacattgtgatttttaattctgtgatcacttctaaggtttataggggacataacaatataaattgttatatacagaaaagtctgagtaacgattagaattagacaactaccctttcaccctagggctgatctggacatttaagaaaagattacatggacacttttgagtgttacaactatttttcttgaagtcctttgaaaaataattgataaatcagtcacaactcctgttgttttcatagctgtgtaatttgtcatatttttttttaaacaatgaattgtatgtaatattatgccttctctaactctcccctaaattgaacttttag

SEQ ID NO: 3899 - DNA, 233 bp, Artificial Sequence
  Synthetic oligonucleotide
gaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcag

SEQ ID NO: 3900 - DNA, 184 bp, Artificial Sequence
  Synthetic oligonucleotide
tgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatat

SEQ ID NO: 3901 - DNA, 410 bp, Artificial Sequence
  Synthetic oligonucleotide
gaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaa

SEQ ID NO: 3902 - DNA, 171 bp, Artificial Sequence
  Synthetic oligonucleotide
gctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattata

SEQ ID NO: 3903 - DNA, 827 bp, Artificial Sequence
  Synthetic oligonucleotide
atgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaagatcggaaattcaagtacggtaatttgttctaaatcaagaatatataagggaaaagtaagtttaaagtgctataatgataatcaagtgttttcatttggtgcgaaaatagaatttaatacttttattatattttaataaccaatgcagtagagctcagattttttttttttttttggaaagt

SEQ ID NO: 3904 - DNA, 14 bp, Artificial Sequence
  Synthetic oligonucleotide
gtaggagcggggag

SEQ ID NO: 3905 - DNA, 26 bp, Artificial Sequence
  Synthetic oligonucleotide
gtgggtactacacaaccgtctccagc

SEQ ID NO: 3906 - DNA, 26 bp, Artificial Sequence
  Synthetic oligonucleotide
cttggtctgagtggactgtcctgcag

SEQ ID NO: 3907 - DNA, 28 bp, Artificial Sequence
  Synthetic oligonucleotide
gcacgtctagattttcccacttacatag

SEQ ID NO: 3908 - DNA, 75 bp, Artificial Sequence
  Synthetic oligonucleotide
agactgcaagtgaggaacttgataatagaagtttagaagagattttgaacagcattcctcctcccccgcctccag

SEQ ID NO: 3909 - DNA, 104 bp, Artificial Sequence
  Synthetic oligonucleotide
caatgaccaatgaagctggagctcctcggcttatgataactcatattgtaaaccagaacttcaaatcctatgctggggagaaaattctgggacctttccataag

SEQ ID NO: 3910 - DNA, 21 bp, Artificial Sequence
  Synthetic oligonucleotide
tttcaaaagataattgataag

SEQ ID NO: 3911 - DNA, 119 bp, Artificial Sequence
  Synthetic oligonucleotide
ttttaaaaagctgcagctttttaatctgtcaacatgttaataatttgtgtgggttttggatatggtgggaatcttgtctacgtcttctcaatcataaacgtttttaggcttgtttggag

SEQ ID NO: 3912 - DNA, 32 bp, Artificial Sequence
  Synthetic oligonucleotide
gaaggggatgattatgaagtcattcctaacag

SEQ ID NO: 3913 - DNA, 18 bp, Artificial Sequence
  Synthetic oligonucleotide
taatttctatgtatccag

SEQ ID NO: 3914 - DNA, 58 bp, Artificial Sequence
  Synthetic oligonucleotide
ggtgaagttgaacaaattgctatgatgaaaccaaaaggccagactgaacacgatgagg

SEQ ID NO: 3915 - DNA, 107 bp, Artificial Sequence
  Synthetic oligonucleotide
gtatgcttgaatatttagaagatataattggttgtggacggctaaatgaacctattaaagtcttgtgtcggagagttgaaatattaaatgaacacagaggagagaag

SEQ ID NO: 3916 - DNA, 80 bp, Artificial Sequence
  Synthetic oligonucleotide
gtacaatgactggtggtggaagcaaagtaatgaaaggaagaatgggttcctcacttgttattgaaatctctgaagaagag

SEQ ID NO: 3917 - DNA, 47 bp, Artificial Sequence
  Synthetic oligonucleotide
gtcacattgctgaacataattctaaaataaaatattggcacaaagag

SEQ ID NO: 3918 - DNA, 118 bp, Artificial Sequence
  Synthetic oligonucleotide
atttcaaaaatatcactgcatcctatagaagataatcctattgaagagatttcggttctaagcccagaggatcttgaagcgatcaagaatccagattctataacaaatcaaattgcac

SEQ ID NO: 3919 - DNA, 65 bp, Artificial Sequence
  Synthetic oligonucleotide
ttttggaagcccggtgtcatgaaatgaaaccaaacctcggtgccatcgcagagtataaaaagaag

SEQ ID NO: 3920 - DNA, 52 bp, Artificial Sequence
  Synthetic oligonucleotide
ctaaaaagtatgttagttgaggcaaagtcctaagcaaggttgtgctatcaag

SEQ ID NO: 3921 - DNA, 19 bp, Artificial Sequence
  Synthetic oligonucleotide
gtgatgagaatttaaatat

SEQ ID NO: 3922 - DNA, 5504 bp, Homo sapiens
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaaggtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggtgggtcacacagatcctacatttttttgtttttgttttttttttttgagacgcagtgattacaggtgtgagccaccggatcctacatttcaaatgcataaaaatctagatatgggctgggcgcagtagctcatgcctgtaatcccagcacattgggaggctgaggcaggcagatcatgaggtcaggagatcgagtccatcctggctaacatggtgaaaccctgtctctactaaaaatacaaaaagccgggcatggcagcgggcgcctgtaatcccagctactcggaaagctgaggcaggagaatcgcttgaacccaggagtcagaggttgcagtgagcagagatcacgccactgcactccaacctgggcgacagagcgagactccacctcaaaacaaaataaacaaaatactagatctggaagagatcttagggattattaaattcagacaacctcattttttatagatggggaaacaagcacagactccaagggcctcatccaagatcacacagttgcagatgctggctacaagtctcctgcctcaaccacctgtattaccccattcagggtctcaagaagggtctataagacactatccattgtgcttcgggctgagtccatagagacaaccacagacatgggggactctgcccacagggaaggcaagggctctggccatggagctggatgggaagactctgaagcccgaagacattgaatcctgtgcagggaaagagcgagggttttgtgtacaacacacctgcatacctggatgtgaatctcagctccaccccttcaccaactctgtgtggcctgggcaagccattctaagggaaccctccacactgcaactttcatgtctataaaatgggaataaccatgcattccttacaggacttttttggtgtgaggattaaatgagagaatatgttgaaaagtgcttggtaaatatattaatactatgcattccctcttctttgaatgacgtgacccaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagagggtgtccgcagagttgctgatcttcctgcccctgggggctactcttgcccagggttgggcaaagcagagtagctgggagtgtaaggagaggaccctcgtcccctcaccaacctcatcctctctccccctacccacaggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 3923 - DNA, 4082 bp, Homo sapiens
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 3924 - DNA, 4120 bp, Homo sapiens
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttggtgagaacccgttttctccttccttccccagcctgtcttgtcccatccctgcccctccacagagtgctagagatgaccccctccccagacttcttcctccctcaattagaaaaattgcagcaggtcatcagacccatgggcagcatcacctgtcctggtctggtcccctgagccctctctgagttctcacctcctcttcccagaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 3925 - DNA, 4504 bp, Homo sapiens
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagagggtgtccgcagagttgctgatcttcctgcccctgggggctactcttgcccagggttgggcaaagcagagtagctgggagtgtaaggagaggaccctcgtcccctcaccaacctcatcctctctccccctacccacaggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 3926 - DNA, 4285 bp, Homo sapiens
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttggtgagaacccgttttctccttccttccccagcctgtcttgtcccatccctgcccctccacagagtgctagagatgaccccctccccagacttcttcctccctcaattagaaaaattgcagcaggtcatcagacccatgggcagcatcacctgtcctggtctggtcccctgagccctctctgagttctcacctcctcttcccagaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 3927 - DNA, 3911 bp, Homo sapiens
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccgagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcagtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcagcttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 3928 - DNA, 3687 bp, Homo sapiens
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacaggtgggtctcagcggggtgggatggggcacggagtgggagacagatccatctaagggcctgttagacaaatgggggaataggcagggaggagggtctctaggcaaattccagggctagaggctgagacttagtgactgaggtgctgggggttgtggggctgtgacaggcagagggaggtgtcagataccaggacaagggtgttgtgaatgctacctcctgcccctactcttgggatggctccaagggctgaggtgtgaatccccagtgtgctccaggaatggggctgtgtgagccaccgtgcccagctccctggccttaaaagtcatgtaatttaatgatcagaccccagtcacagccataggatacaaagaagcaaaggcaaagagccctgtgtcctgggcacggttacaggccagtgtagggaaagagcttctgcttgccagtgtgaagaacagaggagtttaggaagtgtgagtcaggctcagcttagtcaggcagagaccagtgggcatgggttacctgggggtaacgcgggccaggtgggcgggctggcagcctggggcccatttcctgccaaagcacctctgaccatccttctcttcacccaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 3929 - DNA, 1098 bp, Artificial Sequence
  Synthetic oligonucleotide
tgaccaagtggtagactggagaggcctctgccccgtggcacacagctccaccatcagagagggtgatgtgggtcataggtgagggatctggaggcccggtatcggaagagcttctccaggcactggcattttgacagcaaactgcttccgtggctctttcaggactgttcctggcaatatgttattggcaaggactattttagggctatccagttgtctccccctctccccaaccttttatctagcttatcagtagctatctttccttgctctgtacaaaaacctatagcaccaataggcccagtaatcatgaagggtcagtgcaaggaaaggctggaagcccttcctctaacagccgtgctgtgactccactaactttgtggggtctcccattacatagcgtgggtatcctgagctgtgcagcctgcctcactcaccaccttggtacctgacaggactactggatgtgcctgtccttttgtaggacattctcccatcccaaagatgaggctgtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttcccacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggcccctgaagggctggggaaaatcctactgagccccaggctctcctgcctgcactggcccagtgcgggggcgggggggaggggggatcctggacattaactctctcctaggcacctgggagcttcagagaggaagaag

SEQ ID NO: 3930 - DNA, 1165 bp, Artificial Sequence
  Synthetic oligonucleotide
gtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggtgggtcacacagatcctacatttttttgtttttgttttttttttttgagacgcagtgattacaggtgtgagccaccggatcctacatttcaaatgcataaaaatctagatatgggctgggcgcagtagctcatgcctgtaatcccagcacattgggaggctgaggcaggcagatcatgaggtcaggagatcgagtccatcctggctaacatggtgaaaccctgtctctactaaaaatacaaaaagccgggcatggcagcgggcgcctgtaatcccagctactcggaaagctgaggcaggagaatcgcttgaacccaggagtcagaggttgcagtgagcagagatcacgccactgcactccaacctgggcgacagagcgagactccacctcaaaacaaaataaacaaaatactagatctggaagagatcttagggattattaaattcagacaacctcattttttatagatggggaaacaagcacagactccaagggcctcatccaagatcacacagttgcagatgctggctacaagtctcctgcctcaaccacctgtattaccccattcagggtctcaagaagggtctataagacactatccattgtgcttcgggctgagtccatagagacaaccacagacatgggggactctgcccacagggaaggcaagggctctggccatggagctggatgggaagactctgaagcccgaagacattgaatcctgtgcagggaaagagcgagggttttgtgtacaacacacctgcatacctggatgtgaatctcagctccaccccttcaccaactctgtgtggcctgggcaagccattctaagggaaccctccacactgcaactttcatgtctataaaatgggaataaccatgcattccttacaggacttttttggtgtgaggattaaatgagagaatatgttgaaaagtgcttggtaaatatattaatactatgcattccctcttctttgaatgacgtgacccag

SEQ ID NO: 3931 - DNA, 891 bp, Artificial Sequence
  Synthetic oligonucleotide
gtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccag

SEQ ID NO: 3932 - DNA, 308 bp, Artificial Sequence
  Synthetic oligonucleotide
gtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagagggtgtccgcagagttgctgatcttcctgcccctgggggctactcttgcccagggttgggcaaagcagagtagctgggagtgtaaggagaggaccctcgtcccctcaccaacctcatcctctctccccctacccacag

SEQ ID NO: 3933 - DNA, 165 bp, Artificial Sequence
  Synthetic oligonucleotide
gtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagg

SEQ ID NO: 3934 - DNA, 285 bp, Artificial Sequence
  Synthetic oligonucleotide
gtgggtctcagcggggtgggatggggcacggagtgggagacagatccatctaagggcctgttagacaaatgggggaataggcagggaggagggtctctaggcaaattccagggctagaggctgagacttagtgactgaggtgctgggggttgtggggctgtgacaggcagagggaggtgtcagataccaggacaagggtgttgtgaatgctacctcctgcccctactcttgggatggctccaagggctgaggtgtgaatccccagtgtgctccaggaatggggct

SEQ ID NO: 3935 - DNA, 222 bp, Artificial Sequence
  Synthetic oligonucleotide
agaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctca

SEQ ID NO: 3936 - DNA, 165 bp, Artificial Sequence
  Synthetic oligonucleotide
gtgagtccaggcccctggaggctggggagcagctccacatgttgagcccagtcgagttcagtgtggccgtaggcaggccctggagctctgggccagctgcacagccagagagagcccttgagggagggattaggggagtgtgacccttccttccttccttgtcag

SEQ ID NO: 3937 - DNA, 203 bp, Artificial Sequence
  Synthetic oligonucleotide
gtgagaacccgttttctccttccttccccagcctgtcttgtcccatccctgcccctccacagagtgctagagatgaccccctccccagacttcttcctccctcaattagaaaaattgcagcaggtcatcagacccatgggcagcatcacctgtcctggtctggtcccctgagccctctctgagttctcacctcctcttcccag

SEQ ID NO: 3938 - DNA, 164 bp, Artificial Sequence
  Synthetic oligonucleotide
cgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaac

SEQ ID NO: 3939 - DNA, 323 bp, Artificial Sequence
  Synthetic oligonucleotide
gtgtgagccaccgtgcccagctccctggccttaaaagtcatgtaatttaatgatcagaccccagtcacagccataggatacaaagaagcaaaggcaaagagccctgtgtcctgggcacggttacaggccagtgtagggaaagagcttctgcttgccagtgtgaagaacagaggagtttaggaagtgtgagtcaggctcagcttagtcaggcagagaccagtgggcatgggttacctgggggtaacgcgggccaggtgggcgggctggcagcctggggcccatttcctgccaaagcacctctgaccatccttctcttcacccag

SEQ ID NO: 3940 - DNA, 122 bp, Artificial Sequence
  Synthetic oligonucleotide
ctggaaggaggaagaggttctccagagtcggaactgagggttggaactatacccgggaccaaactcacggaccactcgaggcctgcaaaccttcctgggaggacaggcaggccagatggccc

SEQ ID NO: 3941 - DNA, 204 bp, Artificial Sequence
  Synthetic oligonucleotide
cttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcac

SEQ ID NO: 3942 - DNA, 1464 bp, Artificial Sequence
  Synthetic oligonucleotide
cttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaacaaaacaaaatggagatgagtacttgctgagaaagaatgagggaaggagttggcatttgttgaaagtgtagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaa

SEQ ID NO: 3943 - DNA, 118 bp, Artificial Sequence
  Synthetic oligonucleotide
gctctatttagagccgggtaggggagcgcagcggccagatacctcagcgctacctggcggaactggatttctctcccgcctgccggcctgcctgccacagccggactccgccactccg

SEQ ID NO: 3944 - DNA, 114 bp, Artificial Sequence
  Synthetic oligonucleotide
gtaggattccccgcctgtcattccctagcccagctcttgggaaactgcagaggggtccagaggatttgcagttctgaacctgcacactccagtctaggatctccgagcaagagc

SEQ ID NO: 3945 - DNA, 6 bp, Artificial Sequence
  Synthetic oligonucleotide
gtacag

SEQ ID NO: 3946 - DNA, 93 bp, Artificial Sequence
  Synthetic oligonucleotide
cttccagctcttctgatgagctcagttggatcattgagctgctggagaaggatggcatggccttccaggaggccctagacccagggccctttg

SEQ ID NO: 3947 - DNA, 39 bp, Artificial Sequence
  Synthetic oligonucleotide
accagggcagcccctttgcccaggagctgctggacgacg

SEQ ID NO: 3948 - DNA, 42 bp, Artificial Sequence
  Synthetic oligonucleotide
gtcagcaagccagcccctaccaccccggcagctgtggcgcag

SEQ ID NO: 3949 - DNA, 39 bp, Artificial Sequence
  Synthetic oligonucleotide
gagccccctcccctggcagctctgacgtctccaccgcag

SEQ ID NO: 3950 - DNA, 72 bp, Artificial Sequence
  Synthetic oligonucleotide
ggactggtgcttctcggagctcccactcctcagactccggtggaagtgacgtggacctggatcccactgatg

SEQ ID NO: 3951 - DNA, 18 bp, Artificial Sequence
  Synthetic oligonucleotide
gcaagctcttccccagcg

SEQ ID NO: 3952 - DNA, 117 bp, Artificial Sequence
  Synthetic oligonucleotide
atggttttcgtgactgcaagaagggggatcccaagcacgggaagcggaaacgaggccggccccgaaagctgagcaaagagtactgggactgtctcgagggcaagaagagcaagcacg

SEQ ID NO: 3953 - DNA, 32 bp, Artificial Sequence
  Synthetic oligonucleotide
atgacctacgagaagctgagccgggccatgag

SEQ ID NO: 3954 - DNA, 78 bp, Artificial Sequence
  Synthetic oligonucleotide
gtactactacaaacgggagatcctggaacgggtggatggccggcgactcgtctacaagtttggcaaaaactcaagcgg

SEQ ID NO: 3955 - DNA, 5 bp, Artificial Sequence
  Synthetic oligonucleotide
ctcca

SEQ ID NO: 3956 - DNA, 100 bp, Artificial Sequence
  Synthetic oligonucleotide
ctggggaatgctcccagctgtgctgtggagagaagctgatgttttggtgtattgtcagccatcgtcctgggactcggagactatggcctcgcctccccac

SEQ ID NO: 3957 - DNA, 6 bp, Artificial Sequence
  Synthetic oligonucleotide
cctcct

SEQ ID NO: 3958 - DNA, 3237 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3959 - DNA, 4185 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagtaagttttattaaaaattgctctaattactattgctggtttttgtagaatatgactaaaaattattgggtacttcaaatactgactaaattattatttgttttttaatttttttttaagggacagggtcttgatctgtcacccaagctggagtgctgaggtgtgattgtaactcactgcgtcttctaattcttgaggttaagcagtcctcctgcctcagctttctgaggaactgggactacaggcacatgtaaccatgcccagctaattttttgtagagatgaggtctccccttgttgcccaggctagtttctaactcctggtctcaaattatcatcccttcttggcccctcacagtgctgggattacaggtgttagccaccttgcctggcctctggttaaattattaaagtgacctgttaatgtgcttttcttcagtgatcattattggtgggtgggatattctgactggaaaagtttgtattgcatttactttaccatgttttagtgaacggagcaggtatttctttaaattgtaaagaagtcttcataataggggctagatgtgtgaagcctggctttaatttttgcttagtaggatcaatgtcatatttacttattggacgtaacctaggtttcactctttgaacattattttaagggataaaaagttacttgagagtcatgtgaggagttgagcgtggagatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtgttttctttctcataggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3960 - DNA, 4195 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggtatgtattggagtgaactgctttcttttatcaaaaaattacgagtaagttttattaaaaattgctctaattactattgctggtttttgtagaatatgactaaaaattattgggtacttcaaatactgactaaattattatttgttttttaatttttttttaagggacagggtcttgatctgtcacccaagctggagtgctgaggtgtgattgtaactcactgcgtcttctaattcttgaggttaagcagtcctcctgcctcagctttctgaggaactgggactacaggcacatgtaaccatgcccagctaattttttgtagagatgaggtctccccttgttgcccaggctagtttctaactcctggtctcaaattatcatcccttcttggcccctcacagtgctgggattacaggtgttagccaccttgcctggcctctggttaaattattaaagtgacctgttaatgtgcttttcttcagtgatcattattggtgggtgggatattctgactggaaaagtttgtattgcatttactttaccatgttttagtgaacggagcaggtatttctttaaattgtaaagaagtcttcataataggggctagatgtgtgaagcctggctttaatttttgcttagtaggatcaatgtcatatttacttattggacgtaacctaggtttcactctttgaacattattttaagggataaaaagttacttgagagtcatgtgaggagttgagcgtggagatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtgttttctttctcataggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3961 - DNA, 4307 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagtaagttttattaaaaattgctctaattactattgctggtttttgtagaatatgactaaaaattattgggtacttcaaatactgactaaattattatttgttttttaatttttttttaagggacagggtcttgatctgtcacccaagctggagtgctgaggtgtgattgtaactcactgcgtcttctaattcttgaggttaagcagtcctcctgcctcagctttctgaggaactgggactacaggcacatgtaaccatgcccagctaattttttgtagagatgaggtctccccttgttgcccaggctagtttctaactcctggtctcaaattatcatcccttcttggcccctcacagtgctgggattacaggtgttagccaccttgcctggcctctggttaaattattaaagtgacctgttaatgtgcttttcttcagtgatcattattggtgggtgggatattctgactggaaaagtttgtattgcatttactttaccatgttttagtgaacggagcaggtatttctttaaattgtaaagaagtcttcataataggggctagatgtgtgaagcctggctttaatttttgcttagtaggatcaatgtcatatttacttattggacgtaacctaggtttcactctttgaacattattttaagggataaaaagttacttgagagtcatgtgaggagttgagcgtggagatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtgttttctttctcataggaaccactcgttttgactattattttatcactctttgtgaaacttcacaatgttcgggaggacattgtgaatgatattacagctgaacacatttctatttggccatcttccattcccaaacatcacgttgctttgtcgcccaggctggagtgcagtggtgaggtctcagctcactgcaacctacgcctgcaaggttcaagcgattctcatgcctcagcctgccaagtatctgggattacagcctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3962 - DNA, 3277 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgaggacagggtcttgatctgtcacccaagctggagtgctgaggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3963 - DNA, 3359 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaaacatcacgttgctttgtcgcccaggctggagtgcagtggtgaggtctcagctcactgcaacctacgcctgcaaggttcaagcgattctcatgcctcagcctgccaagtatctgggattacagcctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3964 - DNA, 3676 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatctactttatgaggctggattttttttttagaaaagctaatttaaaatatttagaaatagctagcctatgtacagcaagttttcatgtctttttttaataaatagatttctaggagtcagtatatatttaatactcttcttccttaagaaaatagaagtttaggtcaagtgttaagctttatcactttgacactgtccttatctcacaatggaggaatttagaaaggaccttaacagtttcacaaacataaataaagccttagtcacactaaatt

SEQ ID NO: 3965 - DNA, 3061 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaacttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3966 - DNA, 2919 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacaggggtatgttcaagatcagtaaatttagaaaaagcttcagagtctttgaaaggaaacatggctgcttttctaaacttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3967 - DNA, 3186 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3968 - DNA, 3018 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaaggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3969 - DNA, 3310 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacaggtatgaataatattttaaaaataatgaggtcaacatttttctgcttaagaagtaactgaattctgtctttcagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3970 - DNA, 3163 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3971 - DNA, 3749 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacaggtatgaataatattttaaaaataatgaggtcaacatttttctgcttaagaagtaactgaattctgtctttcagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatctactttatgaggctggattttttttttagaaaagctaatttaaaatatttagaaatagctagcctatgtacagcaagttttcatgtctttttttaataaatagatttctaggagtcagtatatatttaatactcttcttccttaagaaaatagaagtttaggtcaagtgttaagctttatcactttgacactgtccttatctcacaatggaggaatttagaaaggaccttaacagtttcacaaacataaataaagccttagtcacactaaatt

SEQ ID NO: 3972 - DNA, 3069 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcagtgtataaaacctctgaaggggggagaggaaaagccgcag

SEQ ID NO: 3973 - DNA, 3209 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggccattttatgtcagttcctcagagaaattgactacaaaacagcgtttaaatctctgcaagaacaaaacaggtatgaataatattttaaaaataatgaggtcaacatttttctgcttaagaagtaactgaattctgtctttcagtcatgatgctatggactcctactacgactacatatgggatgttaccattttggaatacttgacttatcttcatcataaaagaggagaaacagataaaagacaaattgcagtaagttaccttatgcctttcttcagtggtacagtttccagaatattaaacaattgttaagatgtgaaccaacaaaaaatagattttgtgtacctagttactgccag

SEQ ID NO: 3974 - DNA, 3469 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtgaattgttttcgtgggctggctggtttcttgcctacctgtatatgttcttcctgggtccccttttggctgaacttacccatttccttgtaatgtgatcgtaagtcccaggttcatggctctagaacacattgctctgtgtattttcattgtccttatttctagcacctattgctgtcttgattcccccagtaaacacctcaaattcaacttgtccaaactgatttgtgtctgtctttaccataaagtaataaactcctaatacactcctaataaattcacctgtcctttcaaaaacaaaaacaaaaaacctgcaaaataccaaacatttttgtttaaccatttgagtagttcaagcccaaaccctgactatcatttttggcttttttctttactgaccctcctgccaccatccagttagctctcacatcttgtggattctatctcctaaatccctatttttttttcctaatttctttggtatatatttaagatatacagaataatgttttaatatacacagtgagatgattactacagtcaaacaaaaaaacatatccattgccttccttagttacccattttttgtgataagagcacctaaaatctactctcagcaattttttagtatacattatggtataatgaattctagtcctcatactgtatatcag

SEQ ID NO: 3975 - DNA, 4496 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagtaagttttattaaaaattgctctaattactattgctggtttttgtagaatatgactaaaaattattgggtacttcaaatactgactaaattattatttgttttttaatttttttttaagggacagggtcttgatctgtcacccaagctggagtgctgaggtgtgattgtaactcactgcgtcttctaattcttgaggttaagcagtcctcctgcctcagctttctgaggaactgggactacaggcacatgtaaccatgcccagctaattttttgtagagatgaggtctccccttgttgcccaggctagtttctaactcctggtctcaaattatcatcccttcttggcccctcacagtgctgggattacaggtgttagccaccttgcctggcctctggttaaattattaaagtgacctgttaatgtgcttttcttcagtgatcattattggtgggtgggatattctgactggaaaagtttgtattgcatttactttaccatgttttagtgaacggagcaggtatttctttaaattgtaaagaagtcttcataataggggctagatgtgtgaagcctggctttaatttttgcttagtaggatcaatgtcatatttacttattggacgtaacctaggtttcactctttgaacattattttaagggataaaaagttacttgagagtcatgtgaggagttgagcgtggagatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtgttttctttctcataggaaccactcgttttgactattattttatcactctttgtgaaacttcacaatgttcgggtaagtatttcataatttcatttagaaaaatttaaaagaaatttctttgtaaatcacacctttttttttctttttaaaggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtgaattgttttcgtgggctggctggtttcttgcctacctgtatatgttcttcctgggtccccttttggctgaacttacccatttccttgtaatgtgatcgtaagtcccaggttcatggctctagaacacattgctctgtgtattttcattgtccttatttctagcacctattgctgtcttgattcccccagtaaacacctcaaattcaacttgtccaaactgatttgtgtctgtctttaccataaagtaataaactcctaatacactcctaataaattcacctgtcctttcaaaaacaaaaacaaaaaacctgcaaaataccaaacatttttgtttaaccatttgagtagttcaagcccaaaccctgactatcatttttggcttttttctttactgaccctcctgccaccatccagttagctctcacatcttgtggattctatctcctaaatccctatttttttttcctaatttctttggtatatatttaagatatacagaataatgttttaatatacacagtgagatgattactacagtcaaacaaaaaaacatatccattgccttccttagttacccattttttgtgataagagcacctaaaatctactctcagcaattttttagtatacattatggtataatgaattctagtcctcatactgtatatcag

SEQ ID NO: 3976 - DNA, 2894 bp, Homo sapiens
gctggcccgcgccgccattttggattgtgtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaaggtagttaatgtttaaataaaaggattgttaggatggtattattatacttgtttctttaactttatactactttgggaacttgtctaatttctgtgatacaaatgattggacaaatgcttgttgatttgtagttaaaggatagagtttttgataattcatgcacttgaccttgttctaatatttctttctaatgccctgtaattcatgagcatgtagtcacagattatttagttaacagataacacattggtgtaatcctaagtaatgagagattcgctttctttgctttggttgctctaatcacactctagaactgatggagtccgtcagggatgcacttctccttgtttccatttgaacactttattcttctttagaattttatccttctaagtttgctatgtctgaatctccaataggtttgctattagtaattattcccctagtgaaagaatttattcagtaaattggcactaagttattttgttgtcttaattatatcctttgcaacctaaaatgcttctgagtacagaaaatatcaaaactaataagaaactggaggttttttctaagattatatctttcatgtgttaatattatacacactctgagtaagtagtgggtttttctcactttctggttttacagttaaaaaaaaaa

SEQ ID NO: 3977 - DNA, 1237 bp, Homo sapiens
aaaggctgtagtgagctgagatcgcgccattgcactccaacctgggcgacaagaatgaagcttcatctcaaaaaaaacaaaaaacaaacaaaaaaaaacctttttttttttttaaatcatctatagattttaaggccctaaacagtccatagcaaaaaactagtgtgtatatttagttggttgaggcacttctttctaatcatgaaaagttgagcaactatatgctaccatagtgctgagccaccagttatttttgcacattaacaagtggagccctagtttaactctaaaaatcgccatgtagagcttacttatactttcaaataaatttacatgaatttacttaatatattaaaatgccacttaagtaattccataaactatggctcagcagtccatctttccttgagagtggccctggttaatctttatgttaatttttttccaagactcctgggttttacagttaagaggttcagttaatcattaaactgtatcgttgttagcacgtaggtagctttatattacttgtaccaacaaaacttaatttttgacacacctctaataacatcacttttctgttttggaagatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatctactttatgaggctggattttttttttagaaaagctaatttaaaatatttagaaatagctagcctatgtacagcaagttttcatgtctttttttaataaatagatttctaggagtcagtatatatttaatactcttcttccttaagaaaatagaagtttaggtcaagtgttaagctttatcactttgacactgtccttatctcacaatggaggaatttagaaaggaccttaacagtttcacaaacataaataaagccttagtcacactaaatt

SEQ ID NO: 3978 - DNA, 798 bp, Homo sapiens
aaaggctgtagtgagctgagatcgcgccattgcactccaacctgggcgacaagaatgaagcttcatctcaaaaaaaacaaaaaacaaacaaaaaaaaacctttttttttttttaaatcatctatagattttaaggccctaaacagtccatagcaaaaaactagtgtgtatatttagttggttgaggcacttctttctaatcatgaaaagttgagcaactatatgctaccatagtgctgagccaccagttatttttgcacattaacaagtggagccctagtttaactctaaaaatcgccatgtagagcttacttatactttcaaataaatttacatgaatttacttaatatattaaaatgccacttaagtaattccataaactatggctcagcagtccatctttccttgagagtggccctggttaatctttatgttaatttttttccaagactcctgggttttacagttaagaggttcagttaatcattaaactgtatcgttgttagcacgtaggtagctttatattacttgtaccaacaaaacttaatttttgacacacctctaataacatcacttttctgttttggaagatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacac

SEQ ID NO: 3979 - DNA, 260 bp, Artificial Sequence
  Synthetic oligonucleotide
gtgagtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccgg

SEQ ID NO: 3980 - DNA, 141 bp, Artificial Sequence
  Synthetic oligonucleotide
tttgtctgttccagtattgaatatgctactaaatgaactactctgcatcagtaaagttcctcctgggacaaagcatgtagacatggatctggccactttacctccgaccactgccatggctgtacttctctataatagatg

SEQ ID NO: 3981 - DNA, 183 bp, Artificial Sequence
  Synthetic oligonucleotide
ctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccag

SEQ ID NO: 3982 - DNA, 156 bp, Artificial Sequence
  Synthetic oligonucleotide
ataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcag

SEQ ID NO: 3983 - DNA, 142 bp, Artificial Sequence
  Synthetic oligonucleotide
aaatgaagctctagatgaaatctgttttaaagtttgtgcctgtaatacagtccgtgatatactggaaggcagaacaattagtgttcaatttaaccagctatttcttagaccaaataaagagaaaatagactttcttcttgag

SEQ ID NO: 3984 - DNA, 176 bp, Artificial Sequence
  Synthetic oligonucleotide
gaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccag

SEQ ID NO: 3985 - DNA, 134 bp, Artificial Sequence
  Synthetic oligonucleotide
cttcagcaagtgtcaacattggtcagttagagcatcaacttatattgtcagtggatccttggaggattagacaaattttaattgaattacatggtatgacttcagagcgccagttctggacagtgtctaataag

SEQ ID NO: 3986 - DNA, 202 bp, Artificial Sequence
  Synthetic oligonucleotide
gacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctg

SEQ ID NO: 3987 - DNA, 122 bp, Artificial Sequence
  Synthetic oligonucleotide
atattcctcttcgtcaagttatagctgaggaatgtgttgcctttatgttaaactggagagaaaatgaataccttacactccaagttcctgcatttttgcttcagagtaatccatatgtaaag

SEQ ID NO: 3988 - DNA, 660 bp, Artificial Sequence
  Synthetic oligonucleotide
gtagttaatgtttaaataaaaggattgttaggatggtattattatacttgtttctttaactttatactactttgggaacttgtctaatttctgtgatacaaatgattggacaaatgcttgttgatttgtagttaaaggatagagtttttgataattcatgcacttgaccttgttctaatatttctttctaatgccctgtaattcatgagcatgtagtcacagattatttagttaacagataacacattggtgtaatcctaagtaatgagagattcgctttctttgctttggttgctctaatcacactctagaactgatggagtccgtcagggatgcacttctccttgtttccatttgaacactttattcttctttagaattttatccttctaagtttgctatgtctgaatctccaataggtttgctattagtaattattcccctagtgaaagaatttattcagtaaattggcactaagttattttgttgtcttaattatatcctttgcaacctaaaatgcttctgagtacagaaaatatcaaaactaataagaaactggaggttttttctaagattatatctttcatgtgttaatattatacacactctgagtaagtagtgggtttttctcactttctggttttacagttaaaaaaaaaa

SEQ ID NO: 3989 - DNA, 185 bp, Artificial Sequence
  Synthetic oligonucleotide
cttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcg

SEQ ID NO: 3990 - DNA, 120 bp, Artificial Sequence
  Synthetic oligonucleotide
gtaagttttattaaaaattgctctaattactattgctggtttttgtagaatatgactaaaaattattgggtacttcaaatactgactaaattattatttgttttttaatttttttttaag

SEQ ID NO: 3991 - DNA, 788 bp, Artificial Sequence
  Synthetic oligonucleotide
gtgtgattgtaactcactgcgtcttctaattcttgaggttaagcagtcctcctgcctcagctttctgaggaactgggactacaggcacatgtaaccatgcccagctaattttttgtagagatgaggtctccccttgttgcccaggctagtttctaactcctggtctcaaattatcatcccttcttggcccctcacagtgctgggattacaggtgttagccaccttgcctggcctctggttaaattattaaagtgacctgttaatgtgcttttcttcagtgatcattattggtgggtgggatattctgactggaaaagtttgtattgcatttactttaccatgttttagtgaacggagcaggtatttctttaaattgtaaagaagtcttcataataggggctagatgtgtgaagcctggctttaatttttgcttagtaggatcaatgtcatatttacttattggacgtaacctaggtttcactctttgaacattattttaagggataaaaagttacttgagagtcatgtgaggagttgagcgtggagatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtgttttctttctcatag

SEQ ID NO: 3992 - DNA, 122 bp, Artificial Sequence
  Synthetic oligonucleotide
acatcacgttgctttgtcgcccaggctggagtgcagtggtgaggtctcagctcactgcaacctacgcctgcaaggttcaagcgattctcatgcctcagcctgccaagtatctgggattacag

SEQ ID NO: 3993 - DNA, 674 bp, Artificial Sequence
  Synthetic oligonucleotide
gtgaattgttttcgtgggctggctggtttcttgcctacctgtatatgttcttcctgggtccccttttggctgaacttacccatttccttgtaatgtgatcgtaagtcccaggttcatggctctagaacacattgctctgtgtattttcattgtccttatttctagcacctattgctgtcttgattcccccagtaaacacctcaaattcaacttgtccaaactgatttgtgtctgtctttaccataaagtaataaactcctaatacactcctaataaattcacctgtcctttcaaaaacaaaaacaaaaaacctgcaaaataccaaacatttttgtttaaccatttgagtagttcaagcccaaaccctgactatcatttttggcttttttctttactgaccctcctgccaccatccagttagctctcacatcttgtggattctatctcctaaatccctatttttttttcctaatttctttggtatatatttaagatatacagaataatgttttaatatacacagtgagatgattactacagtcaaacaaaaaaacatatccattgccttccttagttacccattttttgtgataagagcacctaaaatctactctcagcaattttttagtatacattatggtataatgaattctagtcctcatactgtatatcag

SEQ ID NO: 3994 - DNA, 590 bp, Artificial Sequence
  Synthetic oligonucleotide
aaaggctgtagtgagctgagatcgcgccattgcactccaacctgggcgacaagaatgaagcttcatctcaaaaaaaacaaaaaacaaacaaaaaaaaacctttttttttttttaaatcatctatagattttaaggccctaaacagtccatagcaaaaaactagtgtgtatatttagttggttgaggcacttctttctaatcatgaaaagttgagcaactatatgctaccatagtgctgagccaccagttatttttgcacattaacaagtggagccctagtttaactctaaaaatcgccatgtagagcttacttatactttcaaataaatttacatgaatttacttaatatattaaaatgccacttaagtaattccataaactatggctcagcagtccatctttccttgagagtggccctggttaatctttatgttaatttttttccaagactcctgggttttacagttaagaggttcagttaatcattaaactgtatcgttgttagcacgtaggtagctttatattacttgtaccaacaaaacttaatttttgacacacctctaataacatcacttttctgttttggaag

SEQ ID NO: 3995 - DNA, 546 bp, Artificial Sequence
  Synthetic oligonucleotide
aaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatctactttatgaggctggattttttttttagaaaagctaatttaaaatatttagaaatagctagcctatgtacagcaagttttcatgtctttttttaataaatagatttctaggagtcagtatatatttaatactcttcttccttaagaaaatagaagtttaggtcaagtgttaagctttatcactttgacactgtccttatctcacaatggaggaatttagaaaggaccttaacagtttcacaaacataaataaagccttagtcacactaaatt

SEQ ID NO: 3996 - DNA, 28 bp, Artificial Sequence
  Synthetic oligonucleotide
gctggcccgcgccgccattttggattgt

SEQ ID NO: 3997 - DNA, 98 bp, Artificial Sequence
  Synthetic oligonucleotide
atcctgcaccagttcaacttatagttcagtttttggaacaggcttccaaaccttcagttaatgaacaaaaccaagttcaacctccgcctgataacaag

SEQ ID NO: 3998 - DNA, 77 bp, Artificial Sequence
  Synthetic oligonucleotide
agaaatcgtattttaaaactacttgctcttaaagttgctgcacatttgaagtgggacttagacatattagagaaaag

SEQ ID NO: 3999 - DNA, 72 bp, Artificial Sequence
  Synthetic oligonucleotide
ggcaattaggacaattgttcaaagtagttttccagtcaaacaggcaaaacccggaccccctcagttaagtgt

SEQ ID NO: 4000 - DNA, 52 bp, Artificial Sequence
  Synthetic oligonucleotide
tatgaatcaaatgcaacaggaaaaagagctaacagaaaacattttgaaagtg

SEQ ID NO: 4001 - DNA, 108 bp, Artificial Sequence
  Synthetic oligonucleotide
gtgtgctatgatttgggcgcagcatacttccagcaaggctccacaaattcagctgtctatgaaaatgccagggaaaaattttttagaaccaaagaactaattgcagag

SEQ ID NO: 4002 - DNA, 101 bp, Artificial Sequence
  Synthetic oligonucleotide
gaggtaatacagattttcattgaagacaacttaaccttgagtttacctgtccagttccgacagtcagtcctaagagaactctttaagaaagctcaacaggg

SEQ ID NO: 4003 - DNA, 71 bp, Artificial Sequence
  Synthetic oligonucleotide
gtatgttcaagatcagtaaatttagaaaaagcttcagagtctttgaaaggaaacatggctgcttttctaaa

SEQ ID NO: 4004 - DNA, 111 bp, Artificial Sequence
  Synthetic oligonucleotide
tgggaagtaccttctgtctatagtggtgttatcctgggaattaaagacaatttaacaagagatttggtttatattcttatggccaaaggtttgcactgcagtactgttaag

SEQ ID NO: 4005 - DNA, 10 bp, Artificial Sequence
  Synthetic oligonucleotide
gtatgtattg

SEQ ID NO: 4006 - DNA, 34 bp, Artificial Sequence
  Synthetic oligonucleotide
gagtgaactgctttcttttatcaaaaaattacga

SEQ ID NO: 4007 - DNA, 40 bp, Artificial Sequence
  Synthetic oligonucleotide
ggacagggtcttgatctgtcacccaagctggagtgctgag

SEQ ID NO: 4008 - DNA, 57 bp, Artificial Sequence
  Synthetic oligonucleotide
gaaccactcgttttgactattattttatcactctttgtgaaacttcacaatgttcgg

SEQ ID NO: 4009 - DNA, 79 bp, Artificial Sequence
  Synthetic oligonucleotide
gtaagtatttcataatttcatttagaaaaatttaaaagaaatttctttgtaaatcacacctttttttttctttttaaag

SEQ ID NO: 4010 - DNA, 62 bp, Artificial Sequence
  Synthetic oligonucleotide
gaggacattgtgaatgatattacagctgaacacatttctatttggccatcttccattcccaa

SEQ ID NO: 4011 - DNA, 77 bp, Artificial Sequence
  Synthetic oligonucleotide
cctccagtctgtggactttgaagctgtggcaatcacagtgaaagagctagttcgatatacactcagtataaatccaa

SEQ ID NO: 4012 - DNA, 42 bp, Artificial Sequence
  Synthetic oligonucleotide
ataaccattcttggttaattatccaggcagatatttactttg

SEQ ID NO: 4013 - DNA, 74 bp, Artificial Sequence
  Synthetic oligonucleotide
caacgaatcagtattcagcagctcttcactattacctccaggcaggagctgtgtgttctgacttctttaacaag

SEQ ID NO: 4014 - DNA, 30 bp, Artificial Sequence
  Synthetic oligonucleotide
gctgtgccccctgatgtttatacagaccag

SEQ ID NO: 4015 - DNA, 51 bp, Artificial Sequence
  Synthetic oligonucleotide
gtaataaaacgaatgataaaatgttgttctttgctgaattgccacacacag

SEQ ID NO: 4016 - DNA, 26 bp, Artificial Sequence
  Synthetic oligonucleotide
gtggccattttatgtcagttcctcag

SEQ ID NO: 4017 - DNA, 48 bp, Artificial Sequence
  Synthetic oligonucleotide
agaaattgactacaaaacagcgtttaaatctctgcaagaacaaaacag

SEQ ID NO: 4018 - DNA, 73 bp, Artificial Sequence
  Synthetic oligonucleotide
gtatgaataatattttaaaaataatgaggtcaacatttttctgcttaagaagtaactgaattctgtctttcag

SEQ ID NO: 4019 - DNA, 65 bp, Artificial Sequence
  Synthetic oligonucleotide
tcatgatgctatggactcctactacgactacatatgggatgttaccattttggaatacttgactt

SEQ ID NO: 4020 - DNA, 44 bp, Artificial Sequence
  Synthetic oligonucleotide
atcttcatcataaaagaggagaaacagataaaagacaaattgca

SEQ ID NO: 4021 - DNA, 107 bp, Artificial Sequence
  Synthetic oligonucleotide
gtaagttaccttatgcctttcttcagtggtacagtttccagaatattaaacaattgttaagatgtgaaccaacaaaaaatagattttgtgtacctagttactgccag

SEQ ID NO: 4022 - DNA, 101 bp, Artificial Sequence
  Synthetic oligonucleotide
atcaaagccatcggccagacagagttgaatgcaagcaatccagaagaagtgttacagctggcagcgcagagaaggaaaaaaaagtttctccaagcaatggc

SEQ ID NO: 4023 - DNA, 40 bp, Artificial Sequence
  Synthetic oligonucleotide
gtgtataaaacctctgaaggggggagaggaaaagccgcag

SEQ ID NO: 4024 - DNA, 1974 bp, Homo sapiens
ctctgtgattggttggtgaaggttttcaaaccggagctgtgggcgcggcgctgctctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagcagtccctggaggaggattgtgtgtccattttacagctggagaagccgagatccagaaaggacccccaagttgtgggcagaataaatctacagcagcttttaactattaaaccaacttagattttggtagtctttcag

SEQ ID NO: 4025 - DNA, 196 bp, Homo sapiens
ctgcacttcttgctgctgccatgtgaaggacatgtttgcttccccttctgccatgattcagtccctggaggaggattgtgtgtccattttacagctggagaagccgagatccagaaaggacccccaagttgtgggcagaataaatctacagcagcttttaactattaaaccaacttagattttggtagtctttcag

SEQ ID NO: 4026 - DNA, 167 bp, Homo sapiens
tggatgagtggggcccagcttggagagatcagtccctggaggaggattgtgtgtccattttacagctggagaagccgagatccagaaaggacccccaagttgtgggcagaataaatctacagcagcttttaactattaaaccaacttagattttggtagtctttcag

SEQ ID NO: 4027 - DNA, 1667 bp, Homo sapiens
tgaggctcagggtggcttttcccagggtcccatggtgaggaagtgggggactgggttggaacctgggtcgagggatctcggggctggaggagggggctggtggggggcgggtcctcgggcgagagacagatcccagcgccgccctcctcccccccagcgccggccccagagccgcgcagagccgcgcagagacgccgcgccttataaggcggcctcggggagcccgggccacgctatataagggccggtttgctttataaagccgggctggtggcgtggggggcggcagggccagggccagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcctgaggc

SEQ ID NO: 4028 - DNA, 1908 bp, Homo sapiens
aggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagggggaagacttgttgatttttccatatcccccggcctgacaaagaaattggggagcgcttgagtgctggggtacctgggaagtgacgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtcccagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcctgaggc

SEQ ID NO: 4029 - DNA, 2332 bp, Homo sapiens
tgaggctcagggtggcttttcccagggtcccatggtgaggaagtgggggactgggttggaacctgggtcgagggatctcggggctggaggagggggctggtggggggcgggtcctcgggcgagagacagatcccagcgccgccctcctcccccccagcgccggccccagagccgcgcagagccgcgcagagacgccgcgccttataaggcggcctcggggagcccgggccacgctatataagggccggtttgctttataaagccgggctggtggcgtggggggcggcagggccagggccaggtgagggggccgcccctcccacctccccccactcacccgggagaagaagaggcagcccggtcccctaggggctgggagcctggctgggcttgggcggagggttctggagaaatgggagtggagtgggggaggggggggacagtggagagagggaaaagcagggaggtggggggagaggcagacagagatactgggagcctgagacaccctagggacagacgggggagggcgagccaggagcgagataagacctagacaaggatggaggggcagggagaggagacagagccccaccacccccaccccaggcaggaaacctggagacagagaaagacctagagaggcagatatacaagacccaggagccctacccctggccagacagggactagccacctagagagatggggacccaagactgggccaagaaaagacagcgctggggaagagagagacagaggagtcggggggataagagggagagagacatacagacgtgcaaggggtgggggctaagacagagacaagcccccaccactaaccagagacagagccctggagctgaagacctgggggacacggagagacagagatgtatgaccagcactcctctgcaagccagcacccagggacacctccttagacatccttcttcccttcctgagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcctgaggc

SEQ ID NO: 4030 - DNA, 1277 bp, Homo sapiens
caaaattagccgggcatggtggcaggcgcttgtagtcccagctactagggagactgatgcaggagaatggtgtgaagccgggaggcggagcttgcagtgagctgagatcacgccactgcactccagcctgggcaacagagcgagactctgtgtcaacaacaacaaaaaaacagtgtccaaggggactgtgcagcctggaggcccccttgtcagtccctgctttccctgccccacctaggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcctgaggc

SEQ ID NO: 4031 - DNA, 6950 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggttatct

SEQ ID NO: 4032 - DNA, 5983 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttg

SEQ ID NO: 4033 - DNA, 6037 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctgga

SEQ ID NO: 4034 - DNA, 6753 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggttatct

SEQ ID NO: 4035 - DNA, 4895 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatg

SEQ ID NO: 4036 - DNA, 7291 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgacttatttgccatgtgcttgggtattatttcaaaacaaggttaaatacaaaggattaagcactgaactgctttattttaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggttatct

SEQ ID NO: 4037 - DNA, 6863 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaattcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggttatct

SEQ ID NO: 4038 - DNA, 6866 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggttatct

SEQ ID NO: 4039 - DNA, 5863 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcagggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggttatct

SEQ ID NO: 4040 - DNA, 3981 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaatt

SEQ ID NO: 4041 - DNA, 3519 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgactt

SEQ ID NO: 4042 - DNA, 3435 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactgcccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcaggtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgactt

SEQ ID NO: 4043 - DNA, 522 bp, Homo sapiens
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagcgcatttgcttcctgaatgatggtcccactcagccatccacctatactttctacaaagtcaatttatactgattcttcagatcagttaatcactggtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctatagtctatagcacgagttcaataaacagttgttaaagcaacat

SEQ ID NO: 4044 - DNA, 1241 bp, Homo sapiens
ctttgttaagttgtttatttggtacagacaagctgccaagactgcaaatgagacggcgcttggttgttgttcattcctgctgatggcttggcgaggccaatcttccttctgtgttgcgaatccacatggcttaacccctccggtccttccctcatcactctgcagcctttgccatgagcatttctcggagctgttgtgagaacccagtgggtcagaggtgacagctttattaaagattaagctgtcctctcttcccttggggctggtaatatttaactcttgctttgcaaattgttttttcatagatttacacactctccaacaggatcatcattgcttgagggcaggtatcacactgtacactttccacaaggccttcactgtcttacacaagcattcaataaatatttgtgggtttagggtgcatgcgtgtgtatgcacacatgtgtacacatgtgcaatgttactggagatggaagagttacacagaaaaccccagggaatcagtcagcaggcaattttaagcccagctgcttggggggtggtgggggtggttgataacaggacaaagtccgcaattatcatttaggggactttttgtaatggaatcctttagagaatcagctcagatgacatattattctaaccccaaactcaagattttctctctggctgcctgtagaaaaagaggtgtgcatttgcatgggaggatagctgttcctgcaaacatttattcaaggacaggaaaaggcagggcccctgagaacaagaaaaaatcagtgggtggttgaaccacgcagtgggaggagtggggtttctgaagccgtcagggcagcatacaaaaccaggctctgctgcttgcagtgaatctctcctccattgtaactgagatacgtatatcctcttttttctttctgctgtttctgtgttaacggcaaatccacttcttaatttcaggaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagatttt

SEQ ID NO: 4045 - DNA, 1732 bp, Homo sapiens
ctttgttaagttgtttatttggtacagacaagctgccaagactgcaaatgagacggcgcttggttgttgttcattcctgctgatggcttggcgaggccaatcttccttctgtgttgcgaatccacatggcttaacccctccggtccttccctcatcactctgcagcctttgccatgagcatttctcggagctgttgtgagaacccagtgggtcagaggtgacagctttattaaagattaagctgtcctctcttcccttggggctggtaatatttaactcttgctttgcaaattgttttttcatagatttacacactctccaacaggatcatcattgcttgagggcaggtatcacactgtacactttccacaaggccttcactgtcttacacaagcattcaataaatatttgtgggtttagggtgcatgcgtgtgtatgcacacatgtgtacacatgtgcaatgttactggagatggaagagttacacagaaaaccccagggaatcagtcagcaggcaattttaagcccagctgcttggggggtggtgggggtggttgataacaggacaaagtccgcaattatcatttaggggactttttgtaatggaatcctttagagaatcagctcagatgacatattattctaaccccaaactcaagattttctctctggctgcctgtagaaaaagaggtgtgcatttgcatgggaggatagctgttcctgcaaacatttattcaaggacaggaaaaggcagggcccctgagaacaagaaaaaatcagtgggtggttgaaccacgcagtgggaggagtggggtttctgaagccgtcagggcagcatacaaaaccaggctctgctgcttgcagtgaatctctcctccattgtaactgagatacgtatatcctcttttttctttctgctgtttctgtgttaacggcaaatccacttcttaatttcaggaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagattttatttgttgtggtttttaattaaaatctcaccagcactttgtggattttttttttcttagaaaggcaaacacactgtgcgtatcagtcagcctggactgccatcacaaaataccatagactgtgtgtcttaaaacaacagaaatgtattttctcacagttctggaggctggaagttcaaggtcaatgttctggatgatttggtttccagtgaggcctctctttcttgcttgcagatggctgccattcttctgtgtcctgtagggaagttcaaacttttcctctgaaggtttgaacaaactgacaatatgcagactaataggaggaagaaaggcattcaaagttgctaatgtgcataagcacaaggccacagaaaatatgagattcaaaggagcaccaggcgcctgaggcttaaataccctcctcataagggagagggaaatggggttgtaggcaattgcgaggggcagtaaatgactttcagtaaacgcatg

SEQ ID NO: 4046 - DNA, 498 bp, Homo sapiens
taaaaatagcttgcgggcaggggagctaccagcagttcagtgcttctggagtttaaagagcccggcgagggtcatgtcagatgacgccggtccacgagaaggagggtggattatatccttagagacgccatagagtgaggatataatggctctgtaacaagcataaactgtgatggtctgggatgccctcgtcatagacagcccctggagagtcgaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagatttt

SEQ ID NO: 4047 - DNA, 650 bp, Homo sapiens
taaaaatagcttgcgggcaggggagctaccagcagttcagtgcttctggagtttaaagagcccggcgagggtcatgtcagatgacgccggtccacgagaaggagggtggattatatccttagagacgccatagagtgaggatataatggctctgtaacaagcataaactgtgatggtctgggatgccctcgtcatagacagcccctggagagtcggcttacaattaagtccatacccccgcctcccgcctggctttcacttccttgcttttggagagaagatgaatggaaatgtatgactttgtctgtggtataaagacatggattcaagttcagggtttgccatggacctgccgtgtgacctttggaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagatttt

SEQ ID NO: 4048 - DNA, 1138 bp, Homo sapiens
ttctacaaatgcattagcattggcatttataaagaaaatgacgaagttgagaggttatagttggttactgcagtgacttagagatgctcattttatagttattaaagcacaacgtgaaccaagttggcagagagataacaaggtaaaaatagcataaggatatgtcctaacaaaatgtccttggtgaagacacaggtagagaaaagaagccataataaagaaattagttccctgaccaaaacaacgggaatatcattcatcgttaaattttgttaatgaattcatgtagcagcggcccattggccttcgagtcacaacataactatgtcttaggtaatgtgattaaataaacttaagtatttatacttaagttcatatcttagtcacacgttatttatatcttagtcacacgttattgagtggaccacataatttcccccgctaaacattatcctttacaggttaaactgctgcagttagaaaactttgtctcaaattcttttgagtttggggtattgttaagaaaaaatgcataattaatcaaatgagagaaaggttttttggggggaggtataatttgtataagtaaactttgattaaccaatgtagctgtttaagtttcttcttccttacaattaacaccgtatttttgcagatattttatattttgactaatgcttctgaggaacaatttaaagaaaaatgcatgcaattatgtagtttatctgcaattcccttaaagaattctaagctaaaaccacaacaaaattattttaaatccagttttcctcatcatagttacaatgtaatccagttttaataaaagattcatattttaaaatccattttcaattgaaatgtaatgaatagcaattgttcctgctcaccttaaaatggaatttgtgctatttttgaaaatttgacatgtaaggctgatcattgtcaaaatgtatgtcatcttgagatgactatatttagcatcaacaaaggaatgcattatctaggtttttgaacagtctttttcccctgaaatttcacttgaagtatttaggttagggtttcatttttgagcagaataaaaactaaatatgcatatttggaagacattaattggggattcagattgcttagaatctga

SEQ ID NO: 4049 - DNA, 7463 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4050 - DNA, 7995 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4051 - DNA, 7638 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacagtaaggccaccgatgggtggggtggaggatgggtcctacctgtttgcctagaaacacctgtgcacactgaaattgcattgggagcaacttctcagggctctgctgaaatctaatggggtcacaaggaggccaccagcagggctctgaaggaaagtgtcctttatgtctggcccagcccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4052 - DNA, 7831 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtgactgaggaggcccagaatgggcagaacaggctggaggatcagaagaagagggcctgtcaaagggcacacctggggcaggctcagggagttggggttggggccacctctagaaaaagaggagctaagggttggggctacatatagctatatataggtgcttctagaaccactgctgtccctgacatgagatgccaggtcagatcagtggaataactccttccccaaatattcagcaggggtgtgtgaaggagggatggaaccgactggttcaaattcctaggtttccgatgccaaggatgctttatgccacttgggaggtacggctgccagagcccatccccagcgcatcccctgtgcccacaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4053 - DNA, 8170 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacagtaaggccaccgatgggtggggtggaggatgggtcctacctgtttgcctagaaacacctgtgcacactgaaattgcattgggagcaacttctcagggctctgctgaaatctaatggggtcacaaggaggccaccagcagggctctgaaggaaagtgtcctttatgtctggcccagcccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4054 - DNA, 7916 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccagggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4055 - DNA, 7253 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4056 - DNA, 7362 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4057 - DNA, 7297 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcagatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4058 - DNA, 7206 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4059 - DNA, 8363 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtgactgaggaggcccagaatgggcagaacaggctggaggatcagaagaagagggcctgtcaaagggcacacctggggcaggctcagggagttggggttggggccacctctagaaaaagaggagctaagggttggggctacatatagctatatataggtgcttctagaaccactgctgtccctgacatgagatgccaggtcagatcagtggaataactccttccccaaatattcagcaggggtgtgtgaaggagggatggaaccgactggttcaaattcctaggtttccgatgccaaggatgctttatgccacttgggaggtacggctgccagagcccatccccagcgcatcccctgtgcccacaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4060 - DNA, 7399 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4061 - DNA, 7400 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4062 - DNA, 8448 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccagggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4063 - DNA, 7571 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatctttatgtcttttgcttgcttgttttccttcggtcaacccacatgtaactaggtcctgtgttgctgctgggaatatagtggtgaataaaacagtttccaccaccaggg

SEQ ID NO: 4064 - DNA, 7174 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4065 - DNA, 7111 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4066 - DNA, 6900 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccat

SEQ ID NO: 4067 - DNA, 4705 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaaggtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactggcttgcaaaggggacaccccttaaaaccaagcaaaatgctctgagaatagaacagaagagcaacatggggcatagttctggagggaggcagcagctttgccagtttcccttccctctcaccttctcactgtgtgtacagcctccaaagatactgtgcctagtcttgaagctgaagctgaacaaaactgtcctttagtgtttactgggtacatgctgggagttcatagtgttactttactcagaaactaaaagccagtaagaaggaagtaacatgaacagatgttaacatctcagccagatgtgtttacagtatgcagtattcctgtcctaaaaaacattaggctggtacaaaagtaattgcatgtttgccattacttttaataaaggcctgggttccttccctctctggcctgaaaaatgtccatgacagctattagcagattcactttactttccacccccctccataccctgtgtattttcatgctgctaataaaggcataccagagactgggcaatttacaaaag

SEQ ID NO: 4068 - DNA, 5158 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggctttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccagggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaaggtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactggcttgcaaaggggacaccccttaaaaccaagcaaaatgctctgagaatagaacagaagagcaacatggggcatagttctggagggaggcagcagctttgccagtttcccttccctctcaccttctcactgtgtgtacagcctccaaagatactgtgcctagtcttgaagctgaagctgaacaaaactgtcctttagtgtttactgggtacatgctgggagttcatagtgttactttactcagaaactaaaagccagtaagaaggaagtaacatgaacagatgttaacatctcagccagatgtgtttacagtatgcagtattcctgtcctaaaaaacattaggctggtacaaaagtaattgcatgtttgccattacttttaataaaggcctgggttccttccctctctggcctgaaaaatgtccatgacagctattagcagattcactttactttccacccccctccataccctgtgtattttcatgctgctaataaaggcataccagagactgggcaatttacaaaag

SEQ ID NO: 4069 - DNA, 3368 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgtgagtgtccttgtgctggggttctgaaaaaacctccacctggtattggatttgtaatcccaagctaagattagggcattagtggtattctcagtcttcacagactgcttgttacccaccctcaaaggtagagctgagggacttagattcctcctcagtcccctgcaata

SEQ ID NO: 4070 - DNA, 3301 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggtaaggatccatttaaaaggagagtggcaatacccctccgggtggctgcctacagccagccccaatgggagactctggagtgaaggaatgaagtgctacctccagagataaccaagaagaagaacagaaagtcagccaggaggctgtggacacagcaacaagggcttccagactgcttgagaaggagacagcaggaagctatgagtttgggaactgtatttgcagagcctttgtttcttcactacccagaagtagagttatccagaggggaatgtcagaaaggtagcccaccatatattaaagaggaaagaaa

SEQ ID NO: 4071 - DNA, 3112 bp, Homo sapiens
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcaggtgagggtgctctctgcccactgttccagtgcatgtggatttcagcttgtttgcataacacagaggtgggcacactatgctataaggggccaagatagtaaatatttttaggctttataggccatatatctctgtcacattcctcaactctgctgttgtagtatgaaagtatccacaaataatatataaactttatttac

SEQ ID NO: 4072 - DNA, 3298 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccaggtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggc

SEQ ID NO: 4073 - DNA, 3257 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccga

SEQ ID NO: 4074 - DNA, 3366 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggc

SEQ ID NO: 4075 - DNA, 3508 bp, Homo sapiens
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccaggtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccga

SEQ ID NO: 4076 - DNA, 6177 bp, Homo sapiens
gaggacagatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggcgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggccgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccaggtgcggcggacgccagacaccgggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactc

SEQ ID NO: 4077 - DNA, 1543 bp, Homo sapiens
ctcccaggtgcaagcgattctcctgcctcagcctcccaagtagctgggattaccggtgcatgccaccacgcccagttaacttttttgtatttttagtagagcggggggtctcgagtcctgacctccgatgatcccacccgcctgagcctcccaaagtgtgggattacaggcatgagccactgcacccggtgatctgtcagccactttccttgtcctctacagctaatcacccagttctgtgcctgtgttttacacacaaaaacctgcacatatttatagcagctttatttataattgccaaaagttggaagcaaccatgatgtacctcagttgatgaatggatttggctgggcctggctcccctctatctaacctgggaagtggagtgtgattgtgtgtgtgtttgttagtggaaggacgtgtggtttctctctgcatggatgaatgagtgtatttggagggtcatggtgctgagagactgcaactgggattcggtctgtgggtatgagtgaagattataagtgtgtaacccctcacatgtgtactgtactttacactttaagtggcagcatagtgcttaaccatggcagcagcagttaacacatagactctgcagctagatttcttggggttcaaattctgcctcaattctgtgtgaccttaggcaaattacttaacttctcagtgcctcagtttcctcacttgtaacacaaggaaatattaacagatccctccccttcttttaggattattgtgagaattagaagagttaatatatgttaggggcttgatacctggcatgtaataagagctaattaagtgttcactgttataatttctcataactacagagtagtttgatatttcagggagaaataatatatgtttgtttcccactgctttcacaacaaccctatgttgtaattagcactgttccactggcacctaaagacacggaggctctgggagatttctggccctaggccacgaaggcccacttgggactcaagctgaggtcctgtgattccatttgggagcaggaggagggatttgcaggtgatcttcctgggcctcctgagagcagctcaggtgcccaagatggactcaggcaggcagctctgctgtatgtgaagcccagtgaggggcagtgggggggccatgctgcaggtacaagttaatctccctgtatcgcctctgcccacttacccttactcctttttctacccagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 4078 - DNA, 1083 bp, Homo sapiens
ggaggtcaggagggaggcgtggacaagggtccggccgtagctggtcccgtcctggaagctgcttaagttcctggttcccaccggggccaagagtgatacctgatcctgggggattgtgaaatgacctcatgtggcagcccgcccgcggtgcccgcaaagccctccaccctccccttccccgctcggctccacccctaccccacgccccctcccgcgcgcgcggttaaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggccaactggctgagtgattcgaagaaagtgaggaatcctccctggacactgtatcgcccttcgtcgtctttcagtcaatctcttccactctaaggattgagtgagcgcgagctggggactctctcaaaggtgcttgctggagctgcagtctccaccaggctatcagaacagggggtggcttaaacagcatggaatctcagctttccgttctccagaggaaaatgctgaggattagaggcagggataggacctggagagaaccaagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 4079 - DNA, 968 bp, Homo sapiens
ctctggtgcatgacgggcttccgggcacgcacagccgggacattgttccccgcggcctggggacccggggccgcagtttccttctcgaaccggccgaagcctgccctgcgggaaagcccggagcctggggcgctcacctctcctcttggagtccctccctgggggcctcccccagccctggggaaagactgggagagcctggcctggcaagattttccccaattcctctgtccaggcggaaaggaactttacagatttaggaaaatgccccgctcatcttaaagatgtgtaagggagcatcggtgagaaaaaaatgttcttgcccaaggtcacaccgccatcccatggctgctggagtcatagtgagggttcagcttttgcctttcaggccaactggctgagtgattcgaagaaagtgaggaatcctccctggacactgtatcgcccttcgtcgtctttcagtcaatctcttccactctaaggattgagtgagcgcgagctggggactctctcaaaggtgcttgctggagctgcagtctccaccaggctatcagaacagggggtggcttaaacagcatggaatctcagctttccgttctccagaggaaaatgctgaggattagaggcagggataggacctggagagaaccaagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 4080 - DNA, 1371 bp, Homo sapiens
ctcccaggtgcaagcgattctcctgcctcagcctcccaagtagctgggattaccggtgcatgccaccacgcccagttaacttttttgtatttttagtagagcggggggtctcgagtcctgacctccgatgatcccacccgcctgagcctcccaaagtgtgggattacaggcatgagccactgcacccggtgatctgtcagccactttccttgtcctctacagctaatcacccagttctgtgcctgtgttttacacacaaaaacctgcacatatttatagcagctttatttataattgccaaaagttggaagcaaccatgatgtacctcagttgatgaatggatttggctgggcctggctcccctctatctaacctgggaagtggagtgtgattgtgtgtgtgtttgttagtggaaggacgtgtggtttctctctgcatggatgaatgagtgtatttggagggtcatggtgctgagagactgcaactgggattcggtctgtgggtatgagtgaagattataagtgtgtaacccctcacatgtgtactgtactttacactttaagtggcagcatagtgcttaaccatggcagcagcagttaacacatagactctgcagctagatttcttggggttcaaattctgcctcaattctgtgtgaccttaggcaaattacttaacttctcagtgcctcagtttcctcacttgtaacacaaggaaatattaacagatccctccccttcttttaggattattgtgagaattagaagagttaatatatgttaggggcttgatacctggcatgtaataagagctaattaagtgttcactgttataatttctcataactacagagtagtttgatatttcagggagaaataatatatgtttgtttcccactgctttcacaacaaccctatgttgtaattagcactgttccactggcacctaaagacacggaggctctgggagatttctggccctaggccacgaaggcccacttgggactcaagctgaggtcctgtgattccatttgggagcaggaggagggatttgcagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagca

SEQ ID NO: 4081 - DNA, 1785 bp, Homo sapiens
ggaggtcaggagggaggcgtggacaagggtccggccgtagctggtcccgtcctggaagctgcttaagttcctggttcccaccggggccaagagtgatacctgatcctgggggattgtgaaatgacctcatgtggcagcccgcccgcggtgcccgcaaagccctccaccctccccttccccgctcggctccacccctaccccacgccccctcccgcgcgcgcggttaaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggccaactggctgagtgattcgaagaaagtgaggaatcctccctggacactgtatcgcccttcgtcgtctttcagtcaatctcttccactctaaggattgagtgagcgcgagctggggactctctcaaaggtgcttgctggagctgcagtctccaccaggctatcagaacagggggtggcttaaacagcatggaatctcagctttccgttctccagaggaaaatgctgaggattagaggcagggataggacctggagagaaccaagataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcaaaaaaagtctctgtctcccctgacttgggttgaggtgggtgggcaagtgttaagggtgtgaccagatcatccaggcatgaagtccagagaaggatcatctggtaggtgttagcattctcctggtggatccctgcatcaaccctatgaatctggtcattattcctccaggaggatggatgagaaaaacgaggctcagacaggtggtggggtgcttccaaagtcactcagattcattgctgggggtgctgataagcagcagcatgcaccaggtgccagacacggtgctgggaggtttgcttatgagatcctctgggtcctcaaaacaatccccagagcagttaacaacatacccctgtcatagacctggactccatgaggttacttgccagtggccacacagaaagatggcaatccaggatcctctcttgttgatactttaagtcaaagttttattttatataagtaatatagtcatatgcatccaaactcaaaagattaaaaaaagatatacaatgaaaagtgtctttcaccctttatcccctgtctccaccttccaccccagccaccaagttgttttctataaagacaaaaaatgttctcagtttcttgggtttcttttcagatatgtatccccagctctcaatcctttctctctcccttctctatttcttcctcttttcctttctattccccctctatgcc

SEQ ID NO: 4082 - DNA, 2800 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatggtgagtggcaggacgtcgtcccaggagggggactgaggagttcacattgattcagcccatgctctacccagacaccgccgcactctgtgcatttgtcaactcactttgtcctcgtgcccttagtatttccattttaccactagggaatggagagacagagaggccgatgttctgatcaaagcctctcacctcctgagtggagtatctgaggctccccctgggcttctaaagagtcgactctcttagccgttaaggttcagggcacatgggtggcagtgctggcactgctagtcctcggagcatgtctcctcacgcacctgctgttcttctccctaagaaagtcgttcactagaggctaccggcgtgggaattgttccatttcctgaagtgcatctgaacatgggcagccagaaggaggtctctcgctaatcagcccctagaaaccaacaagggccaaccaggttccttggggtcatgtcctctcttcccatgagggacagccccagacggaacatggtcctcgctgggatggccttggctcactgagtcttcccccacccccgcctgcctctgccctcttgccagactgcccccaaagagagaatcgcctcctttcttagtggttatttgcacccttcaccggcatcttaagaaaggcatgaagcacctttcagcaaaatatacgacaataccttcttttttttctttttttctttttttgagacgaagtttcactcttgtcgcccaggctggagtgcagtggtgtgatctcgactcactgcaacctccgcctctctgggttcaagcaattatccagcctcagcctcccgagtagctgggactacaggcgtgtgccaccatgcccagctgattatttttagtagagatggggtttcaccatgttggtcaggctggtctcgaactcctgacctcaggtaatctgcctgccttggcctcccaaagtgctgggattacaggcgtgagccactgtgcccagccaagatataacaatacgttttaaaatagaatattaacactttgggaggccgaggcaggcggatcgcaccacagcactctagcctaagcaacagagcaagactccatctcaaaagaaaaaaaaaagagtattaaataacatacacacaaagacaaatgcaaaagtactaacctgtatggactaggactataggaaaacctggaatttgagcattaaatttggctctgagcttactttcccaccctgaaagttctccaaggaaaatgcttgtgcagctgactgccaacccccccagattcctcacgtcccgcacccttctcattatctggcctgcatctctcctgcttcagcaccttctgactcgtttggcctcctggatgccattctccttgtcatttttcttggactgggtgacccatgtctctccctttccctcagccttccttcagatcaaaccaccctgatcctcatgtttcttcctatctcctagatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggaatgg

SEQ ID NO: 4083 - DNA, 1147 bp, Homo sapiens
ggcaggggttgagaggtaggggagatgggctctgagactataaagccagcgggggcccagcagccctcagccctccaggacaggctgcatcagaagaggccatcaagcaggtctttgcgttccaagggcctttgcgtcaggtgggctcagggttccagggtggctggaccccaggccccagctctgcagcagggaggacgtggctgggctcgtgaagcatgtgggggtgagcccaggggccccaaggcagggcacctggccttcagcctgcctcagccctgcctgtcacccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcaggtggggcaggtggagctgggcgggggccctggtgcaggcagcctgcagcccttggccctggaggggtccctgcagaagcgtggcattgtggaacaatgctgtaccagcatctgctccctctaccagctggagaactactgcaactagacgcagcccgcaggcagccccacacccgccgcctcctgcaccgagagagatggaataaagcccttgaaccagcactgctgtgccgtctgtgtgtcttgggggccctgggccaagccccacttcccggcactgttgtgagcccctcccagctctctccacgctctctgggtgcccacaggtgccaacgccggccaggcccagcatgcagtggctctccccaaagcggccatgcctgtcggctgcctgctgcccccaccctgtggctcagggtccagtatgggagctgcgggggtctctgaggggccaggggtggtggggccactgaggagtgacttcttgttcagtagctctggactcttggagtccccagagaccttgttcaggaaagggaatgagaacattccagcaattttccccccacctagccctcccaggttctatttttagagttatttctgatggagtccctgtggagggaggaggctgggctgagggagggggtcc

SEQ ID NO: 4084 - DNA, 3366 bp, Homo sapiens
gctgctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggtgctgggagaccgtgaagtgcaaagcagatggagtccaggccctcggggagacagcacgccagtgagggagatggagaccaatcacccacccagtgtgcggggatgagaagctcgggaaggtctgaccagccttacgtcttgaaagggaatcccctgcttctgcgtgtcaggtgttactcggggtgcgccagtggaagcgggaggcagttgcagctttcagtccagaatgcctcctttctgcctaaacgcctctgatcttcatttgatcatcagcagctgcagacccatgagccactgggcctgacctgggagacactggccctccacttccagtgctctccagctggatttcctccagaacagtggcaaagagttcgcccagagctgcgtcccctccctgggaagcagcgctgagtcagggttacctggctccactgtgcccctagcgaggtgaaagttcgcacaatgacatgggctctctgttgaggataaggaggctacagcccaaggagcttgtgcaccgcaggcagagccactcaggtcatcttccagagcgggatgtctgactccagagcccgccagcccacactgctctcctgaggactgggtttctctggcctgagtctgcctgagtctacaggaagaaccctgctggcaccccagtaagcccctctagaccttggagctctaactgctctcagagctcacttttcagttagcctgtaaggcaggggtgtccaatcttttggcttcccttggccacattggaaggagaattggcttgtgtcacacataaaatacactaacactaacgatagctgatgagctaaaaacaattaaaaatcacaaactcataatgttttaagaaagtttataaatttgtgttgggccacattcaaagccgttctgggctacgggttggacaagcttgctataatggatcagagatatgtacagtcttaaagaagaaacagctcccaggcctgtaagacctatcagggcactcactgaatgctgtgagcaggggaaggggcagtcctgggcagtggggtcctctctgggggtccagctgtgtctccagtcgtctggggagctgggaacagcacaccagggttcttgcctcctgggaaagttctcacagaaagagagaacagaggtgcaaaagctaggccatgttcattattctttcattccctacttattgagctttgacaatgtgtgagggactgcttgattgattgactgattgattgggacagggtctctgtcacctaggctggagtgcagtggtgcaacctcagctccctgtaacttccgcctcctgggctcaagccatcctcctacctcagcctcctgagtagctgggattacaggcccacgccaccacacccggctactttttgtattttttggtagagacagggtttcgctatgctgccaggctggtcttgaacaaccaggctcgagtgatccttctgcctccccttgggctcccaaatgctgggattacaggcgtgagccatcgtctacttctaattttttaaaggaaccaccacactgttttccacagtggctgcatcattttacattttgtatctggtttcttttgcttaatattggtcagggagattcatcaatgtgtacagcacaagtttgtttctttataattgctgtgttaaggattccattgtatgaacaaaacacaatctattaattcccctattgatggacatttggattgttgcccactgtggctattatgaataatgctgtcattaaccgtcttgtacacattttctggtggtcataggcacctgtttctcctgtgggtatatttgggaatggaattgctgggtcatagggtaggcaattg

SEQ ID NO: 4085 - DNA, 1538 bp, Homo sapiens
gctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttg

SEQ ID NO: 4086 - DNA, 1375 bp, Homo sapiens
acaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcagttggcgtttgggggcaagatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttg

SEQ ID NO: 4087 - DNA, 1553 bp, Homo sapiens
gctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatgggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttg

SEQ ID NO: 4088 - DNA, 1390 bp, Homo sapiens
acaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcagttggcgtttgggggcaagatgggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttg

SEQ ID NO: 4089 - DNA, 1985 bp, Homo sapiens
gctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatgggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttg

SEQ ID NO: 4090 - DNA, 1121 bp, Homo sapiens
gctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatgggtggtattacacagacacgacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttg

SEQ ID NO: 4091 - DNA, 2553 bp, Homo sapiens
gttatgagaagaataaagactggaaggaaaatgggagaatgttggggagggttagtttgggataaggaaggtgaggacagggcaggccccaactgacaaggaaacgtttgaataaagagcctaaggaggcaaggcggggagccgcatgggtgtctgggggtaagagtattcaaggcagagggcacggctgggattgatgccctgagatgggagtggttttccatattctaggagcactgagagaccaatgtggctgtagtgagatcaatcggagggacatagggaagagaggaatcctaaggggtcaggtcagagacggcttccagggtttggagtgtgatggggcaccattgtaagattccaggcgggaagttttcctctggatactccatacctttgaaagaccccagcctcaagttctaagcatgtggtgggaggctcccacctggtgcaatccccgcctcagctcctgagaaactcctcatgtggcatttcctgcttgcctcccacttgggccccacagggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaaaaaact

SEQ ID NO: 4092 - DNA, 2480 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaagtaagccagagagcgtgtgcattgcccgggtgctgtgcaggcctgcctcaccccgagtcctggccccccatggggaactccttccctgcaacagcctcccaactccctactttctgtctcttccatttttggctaattgacaactctttctcccactctttcttcctctcctcccctctccaaagttgagcgtcgcaggcgattcaacattaacgacaggatcaaggaactgggcactctcatccctaagtccagtgacccgtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatggagtctcacgctgtcacccaggctggagtgcagtggtgcaatggtacttcctttatttattcaagatttatttattggccgggtgtggtggctcatgcctgtaatcccagcactttgggaggccaaggcggggtcgatcacctaaggtcaggagtttcagactagcctggccaacatgatgaaaccccgtctctactaaaaaatacaaaaattagccaggtgcagtggctcacacttgtaatcctggcactttgggaggccaaggcaggcggatcacctgaggtcaggagtttgagaccagcctggccaacatggtgaaaccccatctctacaaaaaatacaaaaaaaattagctgggcgtggtggcgtaggcctgtcatctcagctactcagaaggctgaggcaggagaatcgcttgaacccaagaagtggaggttgtagtgagccgagattgtgccactgctctccagcctgggtgacagagcgagactccatcccccaccgccccgcaaaaaaaaaggaaaagagaaagatttattttttgaacctctggtttgtgccaggtaccatattaggccctaaagataccagagggaacaaaacagacctcatg

SEQ ID NO: 4093 - DNA, 6282 bp, Homo sapiens
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacagcaaattctttagaaaaggaaaatacagggaaagggataaacctcactgacttggaggaaatcaagaggagtgagcacagcatcagaaagccccctggccccagactgcacccgctttcctggccctaccttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 4094 - DNA, 6139 bp, Homo sapiens
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 4095 - DNA, 6191 bp, Homo sapiens
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctcaccgccgtgcctcaggattctttctcctcgacgctggtacccgtgcggggaaa

SEQ ID NO: 4096 - DNA, 4902 bp, Homo sapiens
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaagatgaacactcttcctgatcctctcctctagaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacagcaaattctttagaaaaggaaaatacagggaaagggataaacctcactgacttggaggaaatcaagaggagtgagcacagcatcagaaagccccctggccccagactgcacccgctttcctggccctaccttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 4097 - DNA, 4389 bp, Homo sapiens
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 4098 - DNA, 2992 bp, Homo sapiens
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccaggcttctcaccagaaacgtaggcatcccaccaggaggggagagtgtggcccaacactagcgttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaattat

SEQ ID NO: 4099 - DNA, 2958 bp, Homo sapiens
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccaggcttctcaccagaaacgtaggcatcccaccaggaggggagagtgtggcccaacactagcgttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaattat

SEQ ID NO: 4100 - DNA, 1886 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 4101 - DNA, 1773 bp, Homo sapiens
cacagaacagtgggctgaaagcaccctagggagggagaattcaaggaagggggcttgggtggccaggctgagccagcgtgagcatgtgaggaggctggtgagctgattgggtgggatgtgtctacttctccagagaagggtgcatgggtctagagcaggtgcctcatgctgtacctcatagagaactggggggaggggggaaatgggcatttccctccacagcccccaaagtgcctgaggaaagtgttgataaagaagccaaactctgtaaaatatttgacagagatttattctgagccaaatgtgaggaccacgacccatgacacagccttggaaggtcctgagaacatgtgtccaagtgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgaatgaattctggaataaatacaaagatggcgaccagtgtgagaccagtccttgccagaaccagggcaaatgtaaagacggcctcggggaatacacctgcacctgtttagaaggattcgaaggcaaaaactgtgaattattcacacggaagctctgcagcctggacaacggggactgtgaccagttctgccacgaggaacagaactctgtggtgtgctcctgcgcccgcgggtacaccctggctgacaacggcaaggcctgcattcccacagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggccctgctcatcaatgaggaaaacgagggtttctgtggtggaactattctgagcgagttctacatcctaacggcagcccactgtctctaccaagccaagagattcaaggtgagggtaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactcaaaaaaa

SEQ ID NO: 4102 - DNA, 3479 bp, Homo sapiens
gactttgctccagcagcctgtcccagtgaggacagggacacagtactcggccacaccatggggcgcccactgcacctcgtcctgctcagtgcctccctggctggcctcctgctgctcggggaaagtctgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacgcccgcgtcctgccttggcctccgtggctcgagctgagagccacagcctagagcgccagcgcgcaggcgcacaactgacgccaggccacgaacccagtactgcgcctgcacagcagaagcactagcactgaggccgggccgcgaacccggcactgcgcctgcgcagcaaaaggacacgcactgaggccaggccgcgaacccagcacggtgcctgcgcagcaggaagaccggcatccacaccggacgacgaacccagcatcgcgcctgcgcagtaggaggagagcgatgccaccaggccgcgattgcgcagccgcagcagccccgcgcggaagacgctgccctcctctcccccgaagaggcggggcttcgaacgaacctggaaatggccgaggggtctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcagtgagcaacagctaggccagccgcggctggtgccatcagccacaccactaactgtggacccaaatggaaactttgaggccccttacaggtcccccagcgcaggccaccgccgaaggttactggggaagacccctgcagcttccatgtggacattactcgcttgcttcatcccggagtgcagtcacctgcagcctgggaccacctgactgatgtcaccctggagatccatgccaaaagagctggggaaagttcaccttctaatgacccctgcggaccagggtgaagttacaagttatggccaggtcaaggaattataagtcaataaataaactgcctcagggagacgtactcagagtccaggaaaatctaggaaacaccaagaagggcgagcgcagcatcagcccctgcaaaattgcactgctgcctcctggctcacatgttgccccatccttactttagcctcaaaggcaaggagacccaatattatttgagtacttggatttgatcctgagtgactttctgagaaagcagtgtatcatctgccctaagatcaccacatatatgacaaggtttttggatgagttgagatttctagacattgaaaccctcatgatgaacgtcatcccgggtagcaggggctaagcctttcatcacctgctacaacaagctggacattaacttgtatttgagaattgctccaggactctaccttcagatgctggttagtagcattgactggatttatgaaattggatgccagttaaggaataagagaatgtatttgatttgccaccctatatggtctgtgcagactgtcatgatctcattgaaatccaagaaaagattatgtcagggatgaagcacatcacaggtggttacaaggtcacccaccatccagatggctcagaaagccaaacctatgggttgacttctcctcacccttctggagaatcagtgtggtagaagagcttgaaaaagtgctgggtgtgacgctgccagaaactaacctctttggaactgaagaaactcaaaaaattattggtgatatctatgtaacaaaagcttttgaaagtcttctacctcagaacatattcaggcgccttgataaacttgtcaaggagttcctgaaagtgacttacatcagtcccacatttatctgttatcacctgcagataatgagctctttgaccaaatgatctctctaagagggtctcactgagcactttgagctatttgtcatgaagatagctgaatgtttccatgcagcaacagcagcagctgttgacaaacaagacaaggccagcaaagatgatgaggccacattcatagatgaaagcttccatgcaaccctggaatatgggcttccgcccacagctggttggagcgtgacaatcaaatgtgttaccatgtttctcacagactcccacaacatcaaggaaatatttctgactcctggcatgaaacttgaagaaagagaatgtagcagccactaatacaatggaaagcgcaacattgacacgtctatctagaaaattttaattgtctaagttgtgtgactcagatatctttgcatttctgcaaaagatcaaggtctactctaattcttaattaaattaagaattcctttttattacttgttagcaaataaatggcttgtctctaacagattttttccactggtagaatttttctttagtaaaagtaaataatgctgatccaagtttatgtttcactcagcatcgtttctcaaacactcttctttacttatatatagctaccctatagctaagctatattttattgtatgatgcatttactcttttcagagtttggccatataagttatttctaaatattgctattaggaaaacacatatgcatgcatttcttctagattatcatctaagagtggcttctccagagagagacgactgaattaaaggttatcaacaagttccaattccagataagatgaagaaatcacattccacactgcctctcccactgagtgtagctccaaaacatggatagaatgcatgtagcagctatttgaggaccctaaaaagtaaatcgcagtgtattgcagaataagactacaattagatgtatgatatgatacaactggctgtgagtttatcattttttcctccagtcttccagacatcacttgacctgaatctaatggacatttataggattctccaccatagccaagtacactttccttccacatatggaaaattcctcaaggtagactatatcctgtgtcttaaagcatacctcaataaaaagattgaactcacataaagtatgttttctgaccataatggaattaaagtaaaaattactaacagaaaaataactggaaacttccctaagtactcggaaattaagtcacacatgtataaataatctgtgagtcaaagagaaaattttaaggggagtaagaaagtattttgagctgaacaaaaatgaatatgtaacataaaatctgtgggatgcagctaaaaaagcagtgtttcaagggaaatttatagcattaaatgctcacatgggaaaagaaagacggtctcaaattgtttatgtaagcttccactttaataaactagaaaaaaagaaaaaaataaaccaaaaggaaattgaaaaagcagaaatc

SEQ ID NO: 4103 - DNA, 4134 bp, Homo sapiens
gattgtccccactggcccctccgggagctgggacctccagaattggaggctgcgccacagaggggcgctgtctggtcggcccggtgtggctggcggcgtgcgggtgctcgcggtctcctgccgggctccccgcccccaggattctgcaggtgctcatcgctctctggccggcggtcagcgctaccgctcgccacgggaaacctacccactgcatgaggcaccagctagccacgtgaggctgtttctgtacacccgaaccgcgctcttgcccagcaaaagcggcagaacctcggctcccttccctaaataagaggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcaatagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacataaaaaaaatg

SEQ ID NO: 4104 - DNA, 3661 bp, Homo sapiens
cccaacagaaattcataaactttcttaaaccattatgagattttttttttgcaatttttttagcttatcagctatcattagtgttagcgtatattatgtgtggcccaagacaatttttcttcttccaatgttgcccagggaagccaaaagattggacccccttgattctagattgtgaaggatgcatcatctgacggcttttttttcctggtatgtgtgtgtaaagttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcaatagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacataaaaaaaatg

SEQ ID NO: 4105 - DNA, 1147 bp, Homo sapiens
cacaggttgggggttaggggagggatagtattaggagaaatacctaatgtagatgacgggttgttgggtgcagcaaaccaccgtggcacatgtatacctatgtaacaaacctgcacattctgcacatgtatcccagaacttaaagtataatttaaaaaaatgaaatcatccacaaaagtacttaccatgtgttgggaattatggaaagcaaacaactgctacattgaaacatggtcaatgagtaaagatattacatttttctttcttcttctgtttagcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacataaaaaaaatg

SEQ ID NO: 4106 - DNA, 4300 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4107 - DNA, 4030 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4108 - DNA, 4140 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4109 - DNA, 4277 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4110 - DNA, 4388 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4111 - DNA, 4190 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4112 - DNA, 4340 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4113 - DNA, 4204 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4114 - DNA, 4441 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatgagcttagaggcgctccgatgaaaatctctggatggctcaagacttcttaaaaaagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4115 - DNA, 4118 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4116 - DNA, 4070 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgaaatctttgtctccttaaaacatctgagagtggattgcccagtacacgcattaaaaagagcaaagctctttctggtttcagtctacaaagctgcaggcacagcatcccagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4117 - DNA, 4028 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4118 - DNA, 1595 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagcttagaggcgctccgatgaaaatctctggatggctcaagacttcttaaaaagcaagtcaattacgtcgtatctcatacattctgttttcctcacaataaatttccctaagacaagaaggagcattcggcacca

SEQ ID NO: 4119 - DNA, 3371 bp, Homo sapiens
ggttctggagacttagggattggcaaaggttaaggtaaaactttactagtaacaatgagtgtggtaggatggaaataagtgtttagattacacgagacctgtaataacataaaagttacaataaaaatccaaccagcagtgtttccatcccagtggccaatttctgagcatagtcacgagagatgctttgtaggcaaacagaattgttctaagggacaaaatccccaacaggaaagaacacaccacaaacactcctgcttaaattaccatagtaacttaggatggctttactatatattgatttacataaagctgcatgttcttatactgtttattgccaaatgtccaatattacaatacactataaggtgcaactgagatttaatgaataaaatggaagtaacaatcctgcctcgtgatagttttagaagcacaaaaacattctgtgtcagattatctgctgtaccgagaaggcgaatcaatccttaatttctgagaacttgttttgtagaacataaagacgttatattgcctccaacactggtatcctaactaacagactatgccttcctagagcttagaggcgctccgatgaaaatctctggatggctcaagacttcttaaaaaagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4120 - DNA, 2495 bp, Homo sapiens
aaaaatatatatatatatatatttatatgtatgcatatatgtttatgtgtattgtgtatggttattctacaaacgaaccaaaaaaatttttttcagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 4121 - DNA, 1431 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcggtgagtgagtcccaggacattcgagtggtcgatgaaaaacagaatcgtgatttactaaaaagcttttgccatcaactttatgccagaatttattttgaacccctaaaagacatttctataatagtactcctagttttcttcatgaaaaatacacttaaagcctaatttggatgcatttcatttatggtaaggagtctatcttttaataacactgtcagaaaaatatatatacttggctaatttcaaaagcgctacacttttaaattggcacttttgaaacagctgcaattggtatgattgtcagtgcccttcccagtctaaaaaatgttacagtctaacagaataaaaataaaaacctactctctctctctctaaataacagttccttacctaagacaaaatactcatgtaaaaagtcttatcctgctccatactggattttgaaatatttcaaggataaatctatcacataaggatttaaaaattatctgatctctaataaccaaatctgtgttctcatctttaaaaatttactagggaaatagattattaatttgtatattcagaaatatttgagatgatttagattttcatagtaaactgcatttatctggaatcaac

SEQ ID NO: 4122 - DNA, 789 bp, Homo sapiens
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggtacagtttcagaacttactatttaacattcctctcaagcaaatacgccttgaaatgctttttttaaatcataggaatttaaaaacactttacaatagagaatgattgatttttaaaatatgtctgatttagctttgtagagatgttccgctaatatccataactaatctgagaggaaatgtggaacaacagaagagtaacagtgtctactcagtaacaagcgttttacgagttaaaaagacatccaaatgcagtactgaaaaatcagaagtcttgatttgtctcactgatgactccgtttttcctagagcagtctgtttaatgcttactggagataaatagatttataggtgaccaagacaatcgattaatgtatcagccacagacttttttaaatagaaaattttctaagtaggaaatcattcatagctctttgaaagatatagggagaggcctcaaggaaag

SEQ ID NO: 4123 - DNA, 1139 bp, Homo sapiens
ctcaggctcgctctgcttcccggcggatctctcttcgccggcaccacggcgctgcgagcccccagcccgcccccacccttcctctcggccttttagctttaaatatttatcagcagcgccggcacgggctggagacgaggccgtttgtcttgcggaggaaggccggtgtttgcagagaatagccattagggtctcccccttctccccccttcccagctaaggatctcagccctgggtgtgtccccctgccccagctcggataaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaaaaaaaacccta

SEQ ID NO: 4124 - DNA, 2739 bp, Homo sapiens
ggaaggaacgcagccagggaaactagctgggccaggaggggtcagacccctgaacaagtgagctgatctctcaaggaggagctggatcggtgtgagggagagcggtaaggaatgcctttctggcttcagcagcctggaggatggggacgtctgggcgttgactcctgggttggaacttttcagcccaccccttcccccagtctcttgccactgggtctctctgcttgggcctcagggatctctaggttcttcactccctctccaagcatcctcctccgggaagccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctagtctgcaaactacggccacatgcaggcttcctgtttgtcaatcaagttttcttggaacccagtcataccgcttccttcaagtattgcctttggctgtggctgctttacatgacaacggagtggagcagttgaggcagagactacatggcccacgagcctaaagtttttactatctgaagctctaagaaaaagtttgcctgcccagaaccccaagctgttatttcaggacccacaaaatggattacttacagacatttacagcaccaacgccctcacacaaccttatagggaaagcaaagagacagaaattagttgtggggagcaaagctggtgaaatctgtttaacctgcaaattctctcctccaattagcgttgatgcacattccaagtaaataatatgcagacatgctcctgggtgttgaagcactgcagcactgcctgggggaaactgaggggacaccctccccacagctgtggtcctcacctctgctcctcgccctccagcaggcgcctgtaggtggcgatctcaaagtccaggccagcttggagttcatcacctcctggtactccctgatcaggcaggccatgtcctgcttggccttctgcagggcaccctccagctcggccagcttgcagcgggcatcactgagggccgcctcaccctgctgctcagactgggccaccgcggcctccagcttggagttctgggaggcaagggagggttattaaggatctctgttctggcttcagggtcagaggccaggtaaccactgaccactgactagcagaagaaaaagaggccttgtctatttgttaggccaggggttgcaaattagtgctcccaggcatgtttgcacagtgtcttcaattttggaaatttaacacaata

SEQ ID NO: 4125 - DNA, 2218 bp, Homo sapiens
gcaggaggagaggttatacctgcccttgaagacagcccagttgggggcagggagtggcagagagggccctcaaaaaggggtccattttggagatatttttcctggctgttggcctccgccacacatggggccgctggagggggcgagggcagacttgactggtgggtttgggaggagtgctgccaaagccaggaactcagggctggccctgctgggctgttctggccagggcccccttcctcagcttagacgaagtgtactcccacacccgcctccctcacgttctcctttccttcgccattcacccagaccggtcttttagatttcataggggcctccccaagctgctccaggcccaggttcccccatgtgttgagctgcaccgtcttactctctgtggtccccagggcctggggccctgagctgctggttttgcagaggcctctattgcctcccacctccagtcataccggctactccttaagggcctttgtgggctccaggctggggtcattttaccatggattgactgtcctgaggccttgctggagaaaggggaaggagagaaaggatattgaggaaggaagagaagaggtcccagacagaagggagggctgggcctggtcatcctcatgatccattgacaggaagaggtggctgttcagatagggaggtggagaacaccacctgtaatgtgatggggagtgaagtggagaggaggccctggagcacattcgtcgagagtcaaccacggggcacttccgtgcaccaggcagacctgcttcctggatcactctgtaggacacttgatttggagtccaaagggagagggctggaagccccaggcagggaaacagccagggggagcatggctctgctaagtggctaaagatgatgttcctcaatcccgctgtgggtggcacgctctggctcctcttgagtttcctccttctcgcccgttctaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccaaaaaaa

SEQ ID NO: 4126 - DNA, 1415 bp, Homo sapiens
agaaagtgccctgattccagagagcaggagaagggtgtccttgtttttcctgaagtgctctgacgacccttcgacattcacagcagacaacgccagcaggaatactggatgatggcgtttgacggtatttgcgggctgccattcccctgcatatctgtactggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccaaaaaaa

SEQ ID NO: 4127 - DNA, 2704 bp, Homo sapiens
ggaaggaacgcagccagggaaactagctgggccaggaggggtcagacccctgaacaagtgagctgatctctcaaggaggagctggatcggtgtgagggagagcggtaaggaatgcctttctggcttcagcagcctggaggatggggacgtctgggcgttgactcctgggttggaacttttcagcccaccccttcccccagtctcttgccactgggtctctctgcttgggcctcagggatctctaggttcttcactccctctccaagcatcctcctccgggaagccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccgagtctgcaaactacggccacatgcaggcttcctgtttgtcaatcaagttttcttggaacccagtcataccgcttccttcaagtattgcctttggctgtggctgctttacatgacaacggagtggagcagttgaggcagagactacatggcccacgagcctaaagtttttactatctgaagctctaagaaaaagtttgcctgcccagaaccccaagctgttatttcaggacccacaaaatggattacttacagacatttacagcaccaacgccctcacacaaccttatagggaaagcaaagagacagaaattagttgtggggagcaaagctggtgaaatctgtttaacctgcaaattctctcctccaattagcgttgatgcacattccaagtaaataatatgcagacatgctcctgggtgttgaagcactgcagcactgcctgggggaaactgaggggacaccctccccacagctgtggtcctcacctctgctcctcgccctccagcaggcgcctgtaggtggcgatctcaaagtccaggccagcttggagttcatcacctcctggtactccctgatcaggcaggccatgtcctgcttggccttctgcagggcaccctccagctcggccagcttgcagcgggcatcactgagggccgcctcaccctgctgctcagactgggccaccgcggcctccagcttggagttctgggaggcaagggagggttattaaggatctctgttctggcttcagggtcagaggccaggtaaccactgaccactgactagcagaagaaaaagaggccttgtctatttgttaggccaggggttgcaaattagtgctcccaggcatgtttgcacagtgtcttcaattttggaaatttaacacaata

SEQ ID NO: 4128 - DNA, 2336 bp, Homo sapiens
ggaaggaacgcagccagggaaactagctgggccaggaggggtcagacccctgaacaagtgagctgatctctcaaggaggagctggatcggtgtgagggagagcggtaaggaatgcctttctggcttcagcagcctggaggatggggacgtctgggcgttgactcctgggttggaacttttcagcccaccccttcccccagtctcttgccactgggtctctctgcttgggcctcagggatctctaggttcttcactccctctccaagcatcctcctccgggaagccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccgccgcacagctgctgagaatgagtttgtggtgctgaagaaggtgagtgggaaagacaggctcgaggagggttgtctgaaaacatatgggacaaaggaccacaggatcctctcacctgagcagcccatggggacctctggccaaggcctgcctgagctgtccaagaggaagtctgcacagcctgtcctgtgggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccaaaaaaa

SEQ ID NO: 4129 - DNA, 4478 bp, Homo sapiens
ggaaggaacgcagccagggaaactagctgggccaggaggggtcagacccctgaacaagtgagctgatctctcaaggaggagctggatcggtgtgagggagagcggtaaggaatgcctttctggcttcagcagcctggaggatggggacgtctgggcgttgactcctgggttggaacttttcagcccaccccttcccccagtctcttgccactgggtctctctgcttgggcctcagggatctctaggttcttcactccctctccaagcatcctcctccgggaagccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcgcggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtaatgccccctgtgccacatgcgaagacccctgccccgggccaatgtgaccctcatgagctgaccctgtgcaagtccccctgcttcaggaatcagcatgcagctgctcagtccaataactccctgaggggccagtcttgaccaacacatttcctgcctttcctctctcctctttgtccctgggggctgtttccaaatcattctggtcttttcccctgactcagtcccagtgaaatgtctcagcccagccctgacctgcactgtctcctttgggtgtctgaccaaggccccgagagagagtagggcagaaagtgtcttctgacaggggtgcttcagaactggtatgaccttcacagattattctagagcaactctcttttgttcaggtgaggaattagagaccagagaagtttagggacttggttgagctcacactgcaaaggtcactgggagagctgggacttgaattttaggtccctgactcctaggagaggacacagagccaacttgggaagcaaagaagcagagagggaaaatggtcattgtgagccatgcgagggccgcagaggctgagggtgggtctggtcatggcaggagccagaaggaggctcaggaaggctgggactggggcttttgaggacaggtctttttgcactcttttctcattgaatagaaacaaaagcctgaagctcaggctgggccccaccctggcacacctgaggggcactggggcagtgagtgagttctgtcccctgcctgtggctgtgtgactaagcaggagtcacacattggctctgactggaggagagcaaacaaggtctctgtggagtgcccccccccaacactcccacttccctagggcaaaagtcaacaggattagtcccatagcaggtggaaccagacaggtgcagagtagggaaggtgtggggccatcattcagcccctgttgtcaggactaacgtgtgtgcatgcgtgtgtgcatacctggtgcccacccccatactccccccaccccaaaccctcagagcaccttcctgtggagccagtctgagatccaggctgggactgaaagaggaactggaagggagtccagggaaggagtacagggagggtccctgtgtgcagctgctcagggagttccgatctgtgcaccctcttgacctggctgtgcactgccaaggcaggggtggacggaaagccttgcagatattttccagcttctacagaacttgagggagtgcaactttgagggtatgggcacctccaaccctgagtctgggctcctgaaggggcttggcctacctggatgtcctgccttccaccccaggttgtccctactgcttccagcagctcttggaactcttgtttccaacacctttttttgagtctcaacataaacattagattaagccattgtggtctcttcctctgtgccttgtttgcccaggtcctcctaagggccaggagtggctccttgggaggaagagtgatgggagctatgggaggaaggatgggggctggatcatcaggcgggacctggttctttcaggactttgtgtatccctcatcctgattctacagggttcctccccttcagactccttctttgcccctgaggggtgggattaggtagtgattagggcatggctggagtcagctgccaaggttcaagtctgggctgtgccacttagcagcttagtgacctgggcagattacgctgcctctctgtgtctctgttcccttctctgataaccacagtaccatcgttataggtttgctgtgaggatgaaatgagctcatgcataagaagcacataatggtgcacaccccatagaacacagtctcatgcatatggctgttattatttgctttttttctcccaggacatgcagcttttgtgctgtcattcacatgtttcctatgtgccccaccaacaaccccccatgccaagactcaaagccctaggaatggccgcgtggaagtcagggaaatttggttttgtagctgacacctgttttttcaggtgtgtctttaaagagtaggggaagggaggcagggcagatttcacagctgcatatggcggaggggggacgggagcatggaggcaaagctgcatcaacaccaggccctcctctactgtaggtacgaagatgaaattaaccgccgcacagctgctgagaatgagtttgtggtgctgaagaaggtgagtgggaaagacaggctcgaggagggttgtctgaaaacatatgggacaaaggaccacaggatcctctcacctgagcagcccatggggacctctggccaaggcctgcctgagctgtccaagaggaagtctgcacagcctgtcctgtgggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccaaaaaaa

SEQ ID NO: 4130 - DNA, 1768 bp, Homo sapiens
gtgttgcttggctggcctgaaatgtttgctgaatgaatgcaatgagctgcctcgagccagcatgagctctctgttcctgcagatgtgcaagcttggaacgccttagaagtatcttaggggtcttgtctacatgccctttaagattctcttcaatacactgagcagttggtgttccaggccaaaccacagaattgcaacttgcccctgggagctgggcccttggagattcaggaatgagtaaaagtgaggcctgtccgtaggagtttaagcttgagaaagtgcagctggaagaggctcagacaccatcttcacctggggtgttatctgaggcccacctgcatcatagttaccatgctgcaaattaaaaacatagcttggagattttccatctctgggagcggggctgggaatctgaatgactttgtgttctgctactgactgacgaaaagttgagctcccagagttgaagtgatttgttccaggtcacacggttagtaggtggagctagtggtgttgaaaccatctaggtctttaggaactggtcaagtgctaggttggggcttcagttgctctgggataccagtgctgatgcccaccatgcagtctggagggtcagcagggcaagcttcatgctgtgaccatgtacagcagctgtagaaactgtttctgggtagggcagtagtatttggcctgtgggttggacagggcaggcctgcttccacccctactaaatgttccctgtactgaggacatggtctccctctgccccatcttgccccaacccccaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcacagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcgggccaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccaaaaaaa

SEQ ID NO: 4131 - DNA, 1673 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcgtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacagctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4132 - DNA, 2041 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttacttcctcccacagcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4133 - DNA, 2232 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcgtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacagctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttacttcctcccacagcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4134 - DNA, 2560 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4135 - DNA, 2169 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtggtaagcagtggcactgtgccagtgtcagaggaccaggaaggactaggaaggttgaggggcaagaggtcccctctgaagcacatgggaccaggacacccaggatggcagctcctgggggcagtgacgtagtcatgcgtccagccctttatccatccacccacctgtgcattcctatttgtccatttatcatctctcctcttacatgcactcatatttgttcacttatccgtcagtcctttcatctgtgaatttcatccatccacgcgccatcctctagcatccaggagtcctacagacccacccatctcatttcatcacccccttctcactcgagcccccattacacctctttgttgctgcttgcagctgtccttccctgggtacctgctttcccaggcactaagcctgtggctaggtgggaagcactgccctcaggcatcttgggtcaggtaggctgcacttcaagtgacaaacggacttgctgctcctttgcagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4136 - DNA, 3119 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccagggggtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttacttcctcccacagcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4137 - DNA, 1973 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4138 - DNA, 1986 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4139 - DNA, 2752 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4140 - DNA, 2481 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtggtaagcagtggcactgtgccagtgtcagaggaccaggaaggactaggaaggttgaggggcaagaggtcccctctgaagcacatgggaccaggacacccaggatggcagctcctgggggcagtgacgtagtcatgcgtccagccctttatccatccacccacctgtgcattcctatttgtccatttatcatctctcctcttacatgcactcatatttgttcacttatccgtcagtcctttcatctgtgaatttcatccatccacgcgccatcctctagcatccaggagtcctacagacccacccatctcatttcatcacccccttctcactcgagcccccattacacctctttgttgctgcttgcagctgtccttccctgggtacctgctttcccaggcactaagcctgtggctaggtgggaagcactgccctcaggcatcttgggtcaggtaggctgcacttcaagtgacaaacggacttgctgctcctttgcagagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4141 - DNA, 1991 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4142 - DNA, 3358 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattaggtctttgagagctggatgcaccattggctcctgtttgaaatgagcaggcactccttggagcaaaagcccactgacgctccaccgaaaggtacagggagtgggagctttagcgtgccagggcttctggaccctcggggctctcctgaagctgctgaggccggggcctccagcactccctggtcccagcaccgcggaatctcccatcctctcagctctcacttctttctcacttctctctctctcctgtctgttccttcttggtttggctgtccccctcccctgacccacccccatcttgtctaagggttcctaagggcccacagaggcctgtcaccacagggtacaggtgacctctctcatagaggatggtacagcacagggtgcctggggtagaacctgcccgaaacactgcagaaaggaatccttgtaatgaccttgccccagtgctgcccgcaatccagtgagggcgccaaggtcacagctgctgccaagagagccttgggcgtttcccacctcatggacaatgcagactaggatgtttttagacccaaagacagagtgctgtttctatcccggtgctgtctctaatttgctatgtaactttggacaagtccccttccctctaggattcagggtcctgaagtagaaggtcaaagggccaccctgcctggggcctcagtttctgcatcagattcatagaaggcaccttacatgctatctccaactcctagctgatgcttaaacccctctaagacatctccaacaaacggtaaaccccatttctacttgagaactcccagtaacaggaagcttagacttaccaaggtgcccattgcttttctctagaatcagaatcgcaagtgcaattccaaactgtaatggtgtttttttgtttgattgtttgtttttgagatagagtctggctctgtcgcccaggctggagtgcagtggtgcgatctcagctcactgcaacctcagcctcccgggttcaagcaattctcctgcctcggcctcccgagtagctgggattataggcatgtgccaccacgcccagctaatttttgtatttttagtagagacagggtttcaccatgttggccaggctggtcttgaactcctgacctcaagtgatccgcccacctcggcctcccaaagtgctaagattacaggcatgagccactgtgcctggcccaaaactgtaatgggctttgagtgtcagaagaaaccatcaacttctgaggtgaattggacacatggccattcacttcctttttgatctcagaccttgttggtctaggcctcagttttcccatccgtgtgatggctggagtgagtaaagccacttgggaagaaggcattaagcccacagcagtggtgtgtgggtctttagctctgctcagaccctggttcagagctcactcactcactgtgtcctcatcatgcctgtcgcttcagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4143 - DNA, 1794 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccaggtaagggccttgcagaggggcatctggtcaccagcagctcatccccagcagggccagctcctttgtgggcaggtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4144 - DNA, 3069 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccaggtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgagataaacaggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccagcactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtagaatgctgaccccctgaaggtgtacccgccactgaaggggagcttcccggagaacctgagacaccttaagaacaccatggagaccatagactggaaggtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattaggtctttgagagctggatgcaccattggctcctgtttgaaatgagcaggcactccttggagcaaaagcccactgacgctccaccgaaagtactgaccaagtgccaggaagaggtcagccacatccctgctgtccacccgggttcattcaggcccaagtgcgacgagaacggcaactatctgccactccagtgctatgggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaaca

SEQ ID NO: 4145 - DNA, 3169 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagaggtatgtgtgagcaccaggaaagggcacaccgatcctggactgcagagccgtgcgcatgtgctgggaagaagcaccggccaggagtcacaggaaagagggattcaggctctgactctaacattgactttttgggtgattttgagcaagtctttggcctgctctgggctccggctccctctcttgtcaaatgagggggttcctttaagagcaggagtttgtaactttccttgcatcacaccgcctccttctgaaaagcagaagagagcatgggttctctccctagagtttcacatgctatgcaggggctttgagatcccactaaagctgggctgtgaatgctaggttaaaggccttggaacaggctgtgcctggtggctcccgcctgtaatcccagcactttgggaggctgaggcgggcagatcagctgaggccaggagttcgagaccagcctggccaacatgttgaaaccccatctctactaaaaatacaaaaattagccagatgtggtggtgtacacctgtaatcccacctacttgggaggttgagacatgagaatcacttcaacctgggaggcagaggttgcagtgagccaagattgtgcaactgtaccccaccctgggtgacacagtgacactctgtctcaaaaaaaataaataaataaataaagaccttgcaccagattttgaaaatgttcaagatcccagtggagaaagagtttctaaaagaggatggtagaagcagttcttcacagaggagttccctcctaattaccacggatcaagggaatgatagttgcaggtgtctgtagagtagatggagacatctgccatcacaggagggattgtgagatgttgggggcaggcaagaaaggagggacaggctctggttaaatttctggagggggctcagggttgacgggggtcatgtccttgcctgtgcccctctcccttgcagccagaggccagcacagccatccaggggacaccaggcccccacttcccagccccaaaatagcctcacccatgtgtttccctcaaaaagggctagaaggctattaccccaatgcccctgctacccccagtctccaaaaagtaatttgcgatctacagggacttacagctaggtgtgatgtcagctgttgccaggcagaaaggggtttgggagaaccctgcagagatgttatgacaagctatgttctggggaacaaggtaacctgctgcagaccattagagctgtggcctgtgaaaaccccagggaatcccatggcaaggagggagactgttttgtgaggaatggattcaggtctaggccacgcgtgaccttggataaatcactgcctctccctgagtctcagtaataatataatagccataatagttctcatccactgtgtacctgtcaccaggcctcagccactgttagttagtactgtgattatttacatacgtaaaggctaaactcaattttaattcttacagtcaccctatgaatcaggtacttttgttgtccctttttacagaagaggaaattgaggtcatattggtaagtgacttacccaagtaatcatagctagtgagtggttggaggcagaatttgaaccaggactagtctgacatcaaagtgttagctcactccaccatttggccccctttcagaggtgcatttgtgggaaggggaggtgagacccctctgagctcagaccactcagtgatttacagacccaggtgggctcagtgttcagagtgcatgtccccttgtctaatccttgtctagttttccctttattcagttactgcttctaaagctggctatgtgtgcttaggccattccagactggagcctgttttggaggcttttgtgaatgcttctgcctggcaacatctgtgtcacgattcctgctagctctggttggctcctgactttggcttttttttttttttttttaattgcagaagaaggtagtgtaaatgaggaaataaagaggggggtgacaagagttggcactctaccagaaccaggggacaggcgttcaagatgcataaagaggaagaaaagcagatgctaaacttaactacgaactcccctgagaattgcactgagtgtaatttatttatagagtgctaacaatgtgctaggtgtggagccaagagctttaccctcatcatcttatttaatgtaacagcccttggagcagatgttttacccgattttactcacacagagggttaatcaacttagatggtcccagaactaaccgactccagagccaggattccaatccaggttatgtggtctcgtcttcagggtgaatctctaggttcttaggcctcctgaggaactgtggtgcagagaggggaaggtactgtcccatgtcgtgtgtgggaggtagagctggggctagaattgggtgtggggttgcagaagcactgaacaggtggaggatgaggctggagagcctgaacacaggctaggccacccgtgttccttgagaaggccaagaagtagaatttgttttcccttcctgtctggtctccccacttcccccccgccccccgcccaccgtcgggtttttgctgtttccttcccgaataactctcccttgggctgggccttatcccagaaagcacagactggcacgcagcaagccaatgagaatgagccagtctgtgatgtcatgagttaccaggcacaagggactcctggagcgtcctaaaccatccttgctggttgctggagtaggcagggtgcagcctcatccttgcagttcccaatgggtctgttttagtccgttttgtgccgctttaacagaataccacagactgcgtaatatacaaacaaacaaacaaacaaacaaaaaacaccca

SEQ ID NO: 4146 - DNA, 795 bp, Homo sapiens
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagaggtatgtgtgagcaccaggaaagggcacaccgatcctggactgcagagccgtgcgcatgtgctgggaagaagcaccggccaggagtcacaggaaagagggattcaggctctgactctaacattgactttttgggtgattttgagcaagtctttggcctgctctgggctccggctccctctcttgtcaaatgagggggttcctttaagagcaggagtttgtaactttccttgcatcacaccgcctccttctgaaaagcagaagagagcatgggttctctccctagagtttcacatgctatgcaggggctttgagatcccactaaagctgggctgtgaatgctaggttaaagtgctgggattacaggcgtgagtcaccacacccagcctggtgaggggcttccttgatgtgtcctcatatggtggaaggcagaagggcaagagagaaccaactccttccatcaagccgtcttacagggcacctaatcccattc

SEQ ID NO: 4147 - DNA, 10373 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4148 - DNA, 8889 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtga

SEQ ID NO: 4149 - DNA, 10184 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4150 - DNA, 11911 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggaagtgaatactctggcaatgcctatggccacaccccctactcctcctacagcgaggcctggcgcttccccaactccagcttgctgagtaagtccctggggctgcccaggcctctgctgggcaggatggatggagtggtggggggcaagggtgggtcaaaggttacctgaaagctgggagtcctcagattatacagagggcctgggagatggtgctgtttgtgatggaagaaggcagcaggagggcagtgtacctggttgtttggggaaagagggcagaagtccagaggcttccaggcattcgtttccctcctgcttctcaagcccatgtcttttaaatctttgttttgtgtaagattcagggctcaggccttgaaggggaggacaagggaggacttgagaaaagcctaagagaggacctcctgcctccacggcttacagtcccacagtgcagacactgacgcagggcacccgccagaatgtaactgccctccttcctgggagccagtttcaagaatgccatcctgttgcccccattaaccatctaagtggctcagaaatactcatgattcagcaccaaacccttaaacagaaatcttttgttccaccacattccccatatttagcctgagatgaagacagtattcagggtcgaggtccagagagtgagcttcagcgagcttccaggcttctcttcacccctctcttgtcctggggtcctgaactgggaagagaagcttttcagcaaagcaaaaccccaccaatggggggacttgagggatcccactagagcctccctgagtggtggccttgggtgtatcagagcaaaccggagccagacagaagcagtgatccaaggatggccaaccccacaggcaccattgcaggctaggaaccatccattccccaagaccccctctcctcccattacctctttgtattccagaaataacttgaaaggtggcagacctgggccctgtttgccagatgagttcaactccaacccagctttccattcaatttagccagaaaagacgagggcaatgagacatgccagggttcaggcaccttcccactgagcctccccaggctgcccatcctgcaggtgtgcagagcctcaccttaagggccgtcaagcccagatcccctttgacccctcagcagtctaatctccctgggtcttaagaaagaagactctctgtcctggcactgtttgggcaaggctagggaggatcccaatgacctctcagtgcacttgattctttggggttccacatgcaattgttttctattgccctctccctattgcaacgagggtgttgaaggtcaaagcagccatagggggaaggggcaagaagccactgttctcattctggccagaaactcaaaggtgaggccagagaaggaggaaatagggctggagaggagttaatcttcgatgatcagataggccagagaaatgaatgattaacttgtgttgtcttaaaggtcagcagatgcagggaaggctatggtgcaattttcctttctgaccagcagtgttgttgttatttttttttaatgtgtccaggttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4151 - DNA, 10947 bp, Homo sapiens
gcagaggccaagtcaggaaagcagctaagggaacgtgtacacacatccatgacgtggatagattcccacagtggcctgtagcccctgtgtcagtcctggaacccagtgctatctatgcctgtgaggaccctgcaccaggtccctgctgctctggcctattagagaaagaaggaaccttgggggtcattcaggccagaagtccacagacagagctcaggccttctctgcccaagctctaccagagagtttctgcttttattcttttgtatttgtttttctcaatgaggtagtgttttaaaatctggttccatgaggagaaggagaaaggtgaaaatcacctgtgccgtcattttacaaaaggaaaagagactctcagaagagaaggggttttccccaaggtcaaacggctcagtattggtatgggaagaccccacatcctcaattccttacacacttttcagagggagggaagaaaataggggattgtgatttggagtgaagggctgagtctgcctgaagagtccccaagcccaaggtgctcctgtgacaccatcccatcgtgggggatgagcatcacataccatttgtgccagcatcttgggagtgagaactggggaaggggtgcagaggggcccacagggcctggccgtgggatttcatggtcacagtcaaacacacacacacacaccagcacctgtactcatagctaatccccacccaaactcctacctgaccctgacagctgtccctgggaatattgtctccttaggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4152 - DNA, 10429 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4153 - DNA, 7524 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttca

SEQ ID NO: 4154 - DNA, 9062 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggaagtgaatactctggcaatgcctatggccacaccccctactcctcctacagcgaggcctggcgcttccccaactccagcttgctgagtaagtccctggggctgcccaggcctctgctgggcaggatggatggagtggtggggggcaagggtgggtcaaaggttacctgaaagctgggagtcctcagattatacagagggcctgggagatggtgctgtttgtgatggaagaaggcagcaggagggcagtgtacctggttgtttggggaaagagggcagaagtccagaggcttccaggcattcgtttccctcctgcttctcaagcccatgtcttttaaatctttgttttgtgtaagattcagggctcaggccttgaaggggaggacaagggaggacttgagaaaagcctaagagaggacctcctgcctccacggcttacagtcccacagtgcagacactgacgcagggcacccgccagaatgtaactgccctccttcctgggagccagtttcaagaatgccatcctgttgcccccattaaccatctaagtggctcagaaatactcatgattcagcaccaaacccttaaacagaaatcttttgttccaccacattccccatatttagcctgagatgaagacagtattcagggtcgaggtccagagagtgagcttcagcgagcttccaggcttctcttcacccctctcttgtcctggggtcctgaactgggaagagaagcttttcagcaaagcaaaaccccaccaatggggggacttgagggatcccactagagcctccctgagtggtggccttgggtgtatcagagcaaaccggagccagacagaagcagtgatccaaggatggccaaccccacaggcaccattgcaggctaggaaccatccattccccaagaccccctctcctcccattacctctttgtattccagaaataacttgaaaggtggcagacctgggccctgtttgccagatgagttcaactccaacccagctttccattcaatttagccagaaaagacgagggcaatgagacatgccagggttcaggcaccttcccactgagcctccccaggctgcccatcctgcaggtgtgcagagcctcaccttaagggccgtcaagcccagatcccctttgacccctcagcagtctaatctccctgggtcttaagaaagaagactctctgtcctggcactgtttgggcaaggctagggaggatcccaatgacctctcagtgcacttgattctttggggttccacatgcaattgttttctattgccctctccctattgcaacgagggtgttgaaggtcaaagcagccatagggggaaggggcaagaagccactgttctcattctggccagaaactcaaaggtgaggccagagaaggaggaaatagggctggagaggagttaatcttcgatgatcagataggccagagaaatgaatgattaacttgtgttgtcttaaaggtcagcagatgcagggaaggctatggtgcaattttcctttctgaccagcagtgttgttgttatttttttttaatgtgtccaggttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttca

SEQ ID NO: 4155 - DNA, 8438 bp, Homo sapiens
tgtcactacagggacccaccaccacacctggctaatttttatatttttggtagagacggagtttcaccatgttggccaggctggtctcgaactcctggcctcaggcaatctgcccgccttggcctcccaaagtgttgggattacaggtgtgagtcactgtgcctggtccctccatccatcttttaattcatctgtcttttcagttatctatcatccatctttccatccatccatctttccatcaatccttttatttttccatccatattcattcgtccattcatcttttcatagaactatcctttaatctgtctttccatctatcctttcatcatccattcttccacccatccctcctctcctatatccatcttttcatccccttttcaatctattcctccattaatctatacatctttctatatatacatccttttatctgtccatctttccatccatcttttcacccatccatcctttcatcatcaatccttccatcattcacactttcattcatccttccatccttccatccatttaccactttttcacttaacaaatactggttgaaggtctactgtataggatgctggggatacagcagtgaataagtcagattcctttattcctggagcttataacctaatggtgaagacaaatggacaataaataagtcaatgaatgaacataataatttattgtctgtgaagacaataaaatgggatgatgtaataaagagccacagggagaggagataactactttagattgggctgtcaggggaggcctctctgagaaggtgttcaaagtgaccattcaagtgataaactggggcagaccatccctggaccaaagaacagcaagggcaaaggacctaaggcaggaactagtttagcatggtagcacaaaattgtagtggctgggtcgagttttaaaaggctactctgatttctaggaaaatgaattgtacatagtcaagagagaaagcacaaagaccagttaggggacagttgcagtagttcttgcaagagatgacagtggcttgagttagggaattagcagtgaaggagggaaaaagagaccctgaaaatatattttggttgcaaagccagcaaaccttgctggtagattggctgttgggatgagaaaatagaggaaacaagaatcatttgtaggtttggggcatggatgatggtggcaagtatatatatggcagaccaggaggggaagtgatgtagtagatggcaagtggaaatcaagagttttttgggccgtgttatgattgagatgcctactaaatgtccagttttaataagtcagcaggtacatcatgtgtgtctgaagccaggaaagaatcctgactagagtataaatttcagccattgcacaaagctgtcatttaatgacaagactactagaaaccaagcctggggttcttcaacaatttagagctctaacagagaaggaacagcaaggagaatgagtaggaaagacaactgagttacaaagcaaacagaagactgggcatcacaaacccaaaggcatgagacagggatgagctaaaaggtcaagggaattgaggatatagaagtgaccattggtatgatggagttagagactgtggggacttgaggggatcagagttggcctgataggaagggataagaaggtgaaggcagagaccatggggcagagaaaggcactggtagctagagaggaatgtggggataggaagaggattttttaaagacagaagatagcagaatatgtttgcagggtgaagggagagactgatgaaacagaaaacgggatcattggagcggccaaatccttggaaaggtgagtagggtgggatgcagagcaaagaggcagggttggcctttcatcggggcagagacgtttcatctgctgtgactgcaagcaggtaggcacatctgatgacgggaagatgccacacccaggtgtgtaccacctaccgagctccatcccctgccccaggttccatgtgactgaggtactcggtaaatggtagttaaatacataaataagtgggtgagtgagtgaatgcatgaatgagtgacaaaatgagagggtaaacacatcatgttttccacctctctcccttgtcctctagagctcactgtgtttgccattgggtagggtgtggtaaaaggtgagagggcccttgctgtgtggccagtagagaatcggctgaaacccgggagacctgagttaaacaggaggcagttggcactgggagatgcaagagagagtgccattgtggaaggacggggccagggttctagttctggctttcactgaatatgtgaccttggccaaatgtctttacttccctatgtcacagctgtgttatctgttaaacagatgtttagagtagattatttcttagtttttcatctgttaaatagatgtttcgattagattatttcttaggtttttttttctttgcttttttacttctttacccccttcctttttttacccatgttttttgcttgatttacgttagacttagtctctgcccctaaggaactttcttactgtgttctcagtccgtcattgacttcctagacaaggagaggatccagtagcctttctctgctttaggctgctcctcttcatctctcttcttcctgtataaatgcctacttgtctggcaataaagcagctcccactaaccccaacccaggccttaagactggttggatgactgatttaagcctccattgagctttattttcgcacctgtttaatgggaaaataataaaagcttagatttattgagcactccctgtatatttgaagcatggtgctaagcatttaatacatattttgtcatttaattctcattaaaccaaatgagatagggataattatttggcccattttacagataaggaaaccaaggttcacctgtaagtcactcactcagagaggctaagtgacttgtccaagtttacataaccaggaaatgggaagtaaggatttgactctagacaggtcagctccagagtcagggagtttcgagcaacccctccaaagagtctggggaaggagactcagaaccacatagctcccaatcgtaggtgagtttctgaaaggctgggtggacattcattgagtctcagggttggcaggaatctagctttgtaaatggaattatcgcataagtgaataaagggattatctgcaatttggagtcaagagccctaaggtcgagttctactctgacatttaacaacagtgtgatttgaggcaaactgcttaatcatgctgcactccagtttccttttctataaattggtagtatccatgagtacctcatggggtagtcttgagaataaaagatcataatgtatgggaaagtgctttacaaactttaagctctttaccaagcaccggtagtagctgtggtgatcagtttgactttgtttttgttatgtaagggaattcttaagtaatttcttcggtaaataattcctttggaaaactcaagaatccattaacagaaggaggtgatctgatttactttgtgtaaatttatacgttgagtttgcttaaagcggcagactcaggatggaacaacaaactactccaagtcccaggacacagcttcctgagggtgtgtgccctctggggctctccctcctctcccatccttaaccctcacacctcccctcagccccccatgcacacaaacacacacactcatacctagcgaggctaaaaggttcatatatatggatgtcctctttggcccctaaccccatacccctgctgtggggccctcccagaagagcccttctccagaaggtccaggcagcagaaggagcagttagtccctgggccctacactcacagcacagtttcccagctccaccaaaccctccagctctgggagcttccgcagatcccagaggctcagtttcttcatctggaaaatgggggtagttataacatctaccttctgggcctcctgggagggctgtagtatgtcaagccagtgcctccagtacctacggaaaaggacactgccccaaattttccagatcgatgggttccaaaagggatgacagagggaccttctgagctccattgtccctgccgtggctccaactgtctcccccaccattcctgagcttgcccattgccagccctgcagaccttcccacaccccagccctgcattgatgcccttcacctcacaggcctctcccctgtgtgcctccaacaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4156 - DNA, 10088 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4157 - DNA, 5589 bp, Homo sapiens
tgtcactacagggacccaccaccacacctggctaatttttatatttttggtagagacggagtttcaccatgttggccaggctggtctcgaactcctggcctcaggcaatctgcccgccttggcctcccaaagtgttgggattacaggtgtgagtcactgtgcctggtccctccatccatcttttaattcatctgtcttttcagttatctatcatccatctttccatccatccatctttccatcaatccttttatttttccatccatattcattcgtccattcatcttttcatagaactatcctttaatctgtctttccatctatcctttcatcatccattcttccacccatccctcctctcctatatccatcttttcatccccttttcaatctattcctccattaatctatacatctttctatatatacatccttttatctgtccatctttccatccatcttttcacccatccatcctttcatcatcaatccttccatcattcacactttcattcatccttccatccttccatccatttaccactttttcacttaacaaatactggttgaaggtctactgtataggatgctggggatacagcagtgaataagtcagattcctttattcctggagcttataacctaatggtgaagacaaatggacaataaataagtcaatgaatgaacataataatttattgtctgtgaagacaataaaatgggatgatgtaataaagagccacagggagaggagataactactttagattgggctgtcaggggaggcctctctgagaaggtgttcaaagtgaccattcaagtgataaactggggcagaccatccctggaccaaagaacagcaagggcaaaggacctaaggcaggaactagtttagcatggtagcacaaaattgtagtggctgggtcgagttttaaaaggctactctgatttctaggaaaatgaattgtacatagtcaagagagaaagcacaaagaccagttaggggacagttgcagtagttcttgcaagagatgacagtggcttgagttagggaattagcagtgaaggagggaaaaagagaccctgaaaatatattttggttgcaaagccagcaaaccttgctggtagattggctgttgggatgagaaaatagaggaaacaagaatcatttgtaggtttggggcatggatgatggtggcaagtatatatatggcagaccaggaggggaagtgatgtagtagatggcaagtggaaatcaagagttttttgggccgtgttatgattgagatgcctactaaatgtccagttttaataagtcagcaggtacatcatgtgtgtctgaagccaggaaagaatcctgactagagtataaatttcagccattgcacaaagctgtcatttaatgacaagactactagaaaccaagcctggggttcttcaacaatttagagctctaacagagaaggaacagcaaggagaatgagtaggaaagacaactgagttacaaagcaaacagaagactgggcatcacaaacccaaaggcatgagacagggatgagctaaaaggtcaagggaattgaggatatagaagtgaccattggtatgatggagttagagactgtggggacttgaggggatcagagttggcctgataggaagggataagaaggtgaaggcagagaccatggggcagagaaaggcactggtagctagagaggaatgtggggataggaagaggattttttaaagacagaagatagcagaatatgtttgcagggtgaagggagagactgatgaaacagaaaacgggatcattggagcggccaaatccttggaaaggtgagtagggtgggatgcagagcaaagaggcagggttggcctttcatcggggcagagacgtttcatctgctgtgactgcaagcaggtaggcacatctgatgacgggaagatgccacacccaggtgtgtaccacctaccgagctccatcccctgccccaggttccatgtgactgaggtactcggtaaatggtagttaaatacataaataagtgggtgagtgagtgaatgcatgaatgagtgacaaaatgagagggtaaacacatcatgttttccacctctctcccttgtcctctagagctcactgtgtttgccattgggtagggtgtggtaaaaggtgagagggcccttgctgtgtggccagtagagaatcggctgaaacccgggagacctgagttaaacaggaggcagttggcactgggagatgcaagagagagtgccattgtggaaggacggggccagggttctagttctggctttcactgaatatgtgaccttggccaaatgtctttacttccctatgtcacagctgtgttatctgttaaacagatgtttagagtagattatttcttagtttttcatctgttaaatagatgtttcgattagattatttcttaggtttttttttctttgcttttttacttctttacccccttcctttttttacccatgttttttgcttgatttacgttagacttagtctctgcccctaaggaactttcttactgtgttctcagtccgtcattgacttcctagacaaggagaggatccagtagcctttctctgctttaggctgctcctcttcatctctcttcttcctgtataaatgcctacttgtctggcaataaagcagctcccactaaccccaacccaggccttaagactggttggatgactgatttaagcctccattgagctttattttcgcacctgtttaatgggaaaataataaaagcttagatttattgagcactccctgtatatttgaagcatggtgctaagcatttaatacatattttgtcatttaattctcattaaaccaaatgagatagggataattatttggcccattttacagataaggaaaccaaggttcacctgtaagtcactcactcagagaggctaagtgacttgtccaagtttacataaccaggaaatgggaagtaaggatttgactctagacaggtcagctccagagtcagggagtttcgagcaacccctccaaagagtctggggaaggagactcagaaccacatagctcccaatcgtaggtgagtttctgaaaggctgggtggacattcattgagtctcagggttggcaggaatctagctttgtaaatggaattatcgcataagtgaataaagggattatctgcaatttggagtcaagagccctaaggtcgagttctactctgacatttaacaacagtgtgatttgaggcaaactgcttaatcatgctgcactccagtttccttttctataaattggtagtatccatgagtacctcatggggtagtcttgagaataaaagatcataatgtatgggaaagtgctttacaaactttaagctctttaccaagcaccggtagtagctgtggtgatcagtttgactttgtttttgttatgtaagggaattcttaagtaatttcttcggtaaataattcctttggaaaactcaagaatccattaacagaaggaggtgatctgatttactttgtgtaaatttatacgttgagtttgcttaaagcggcagactcaggatggaacaacaaactactccaagtcccaggacacagcttcctgagggtgtgtgccctctggggctctccctcctctcccatccttaaccctcacacctcccctcagccccccatgcacacaaacacacacactcatacctagcgaggctaaaaggttcatatatatggatgtcctctttggcccctaaccccatacccctgctgtggggccctcccagaagagcccttctccagaaggtccaggcagcagaaggagcagttagtccctgggccctacactcacagcacagtttcccagctccaccaaaccctccagctctgggagcttccgcagatcccagaggctcagtttcttcatctggaaaatgggggtagttataacatctaccttctgggcctcctgggagggctgtagtatgtcaagccagtgcctccagtacctacggaaaaggacactgccccaaattttccagatcgatgggttccaaaagggatgacagagggaccttctgagctccattgtccctgccgtggctccaactgtctcccccaccattcctgagcttgcccattgccagccctgcagaccttcccacaccccagccctgcattgatgcccttcacctcacaggcctctcccctgtgtgcctccaacaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttca

SEQ ID NO: 4158 - DNA, 7239 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaactctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttca

SEQ ID NO: 4159 - DNA, 5258 bp, Homo sapiens
gggggggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 4160 - DNA, 1438 bp, Homo sapiens
aggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagggagcgcgggaccaagcggcggcgaaggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatcca

SEQ ID NO: 4161 - DNA, 1418 bp, Homo sapiens
aggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagggagcgcgggaccaagcggcggcgaaggaggggaagaagagccgcgaccgagagaggccgccgagcgtccccgccctcagagagcagcctcccgagacaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatcca

SEQ ID NO: 4162 - DNA, 1468 bp, Homo sapiens
aggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagggagcgcgggaccaagcggcggcgaaggaggggaagaagagccgcgaccgagagaggccgccgagcgtccccgccctcagagagcagcctcccgagacaggcacttgctggattctccaaaagtatctgcagtggctgttccaccaggaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatcca

SEQ ID NO: 4163 - DNA, 1508 bp, Homo sapiens
aggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagggagcgcgggaccaagcggcggcgaaggaggggaagaagagccgcgaccgagagaggccgccgagcgtccccgccctcagagagcagcctcccgagacagctggctgagaagatcttctgaaatccaaaatgattgtagggttggcggtgagctgatctccggcctcgaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatcca

SEQ ID NO: 4164 - DNA, 1556 bp, Homo sapiens
aggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagggagcgcgggaccaagcggcggcgaaggaggggaagaagagccgcgaccgagagaggccgccgagcgtccccgccctcagagagcagcctcccgagacagctggctgagaagatcttctgaaatccaaaatgattgtagggttggcggtgagctgatctccggcctcgaggtggcttcagggggcccacctggttaagggaaatttggcagtgcgagggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatcca

SEQ ID NO: 4165 - DNA, 3356 bp, Homo sapiens
cggccgcgttgccaaggtgacccgggcgcgggaaggcggctccggctcgcgcgggccgggccgggcggcggcggcggcaccatgagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4166 - DNA, 3868 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttgggttaatacctctgccaaccgaggccaccctccctcggacccccattcggaggaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4167 - DNA, 3743 bp, Homo sapiens
cggccgcgttgccaaggtgacccgggcgcgggaaggcggctccggctcgcgcgggccgggccgggcggcggcggcggcaccatgagcggccggaagcgcagcttcaccttcggggcctacggcgggtagggcgtggcgcggcgcggggcggggcgcgtgcgcgcgtgtgcgtgtgcacgcgtgggggggagcccgtgcggggtgtgctcgcgtttgggcgggtgggcctgggctatgactgctgtgggggctgagcgtttgacctcagtgcgcgcatggctgtcgtgctgtggcgcctgtgtgtgtgtgtttctgtttctgtgtctgtgtgtgttcccattgcgtgtccatgtgcatgtgtggggaggtgagtgcagggtggacattgctgtgtttgtgtctaagcacatgatagtggcgcttatgcatgtgactggggctgcggggctactccgcctgtgtgtgcgcgcgtgtgtgtgcatgcgtgtgtgcgcaactgctcacatgtatagggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4168 - DNA, 3403 bp, Homo sapiens
gggctcttgacgggctcctgcacccaccagaatgtgcagagaagaggtcccaggtgggagccgagagggggctgagggcagatccccaagagagaagtaattggtgtgagagaggatctcaatttcttcgtgtctaaaatggggaaactgcagcgccacttaccctgcctagggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4169 - DNA, 3422 bp, Homo sapiens
gatctccacagcggtggagaggaggaagggtgaacgccgtggtggagtggtccatgtggacctgctcccctttgctgccaggaggttaatacctctgccaaccgaggccaccctccctcggacccccattcggaggaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4170 - DNA, 3844 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtttggtgccagctgcggggcgcctgggcttggggaagaaaccttgtgtacgcacacctgcacacacacacagtctccggagggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4171 - DNA, 3832 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttgggttaatacctctgccaaccgaggccaccctccctcggacccccattcggaggaagcagacccaagttcgaattctgacattgccactgagcagccgtacaacttttggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4172 - DNA, 3112 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtttggtgccagctgcggggcgcctgggcttggggaagaaaccttgtgtacgcacacctgcacacacacacagtctccggaggttaatacctctgccaaccgaggccaccacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4173 - DNA, 3008 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcaggttagacccagcccctcagcttgtgtttggtgggagagggtgggggtgtgtagagggctgagctgattcctccctgttcttctgtcacctctctggggtgggagctatgtatctgggtttgagccccctggtcctcagttgctgggtgacttgggcaggccacggcccttccccgtgacctctgcccttgcattgttggaggatttgatgggagtgtgaaagggacttggcagttgccaggtggggagaagtttcaggggttcccaatgggatggaaagacctggagcctggaattccaagggt

SEQ ID NO: 4174 - DNA, 3039 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccagtgaggtggctccctcctgcccccctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcaggttagacccagcccctcagcttgtgtttggtgggagagggtgggggtgtgtagagggctgagctgattcctccctgttcttctgtcacctctctggggtgggagctatgtatctgggtttgagccccctggtcctcagttgctgggtgacttgggcaggccacggcccttccccgtgacctctgcccttgcattgttggaggatttgatgggagtgtgaaagggacttggcagttgccaggtggggagaagtttcaggggttcccaatgggatggaaagacctggagcctggaattccaagggt

SEQ ID NO: 4175 - DNA, 4257 bp, Homo sapiens
ctgggaattctgctgaagggtggaggattctgggagacagcaagggctgctggtacaaaggctgctaggtcagcaggaagagaagagaggaagaggctctgtcttgactgagggaaagttctcagaagaggtgtgtgaaccatgatcattggagagggacttggcctgtgtgacctaccctgcctgtccctggtttagcttagcattaagagcacggacacttcaaatttcagctctgttacttaccagcttgggcattctgtgagcatcagtttctttatctgttgagtagggtaatggcaacttgcctcatacagttattgttatctgtaaaagagttaggttagtgcaatacaagtttaaaagcaaaatgcaaaaccttgcctgtctgcctcagcaaatgttgtctgaaatgagaagtgtggggagtggagtagttcctggacagggtctggactcactcaggccacagggccccaggtggtagcctttttgccaccgtctcctccacccacaggaggataactgcccatcctccagcttcccggccggctggtcacacctcaccctcaacccaggacaggtcacacagctggagctatgggttggaataagggaattagcccggctgcccaggcctgcccaggaactgaggtgaacagatcgtctttgagaaagaggcttggggactggagacaggacaggtggggtcaatatggatctggggtgtctcctttgaggagggctccgatggtcccacatctggtaggtgctggacggtggacctagattaggtcaaagaatttctcagaagcagcggagtccagagttgagggcatgggtcctggcatgccgggctcacccctgcctcagttggcatgaaatgggcatgattgctagtccccatcttgcagggggatccagtgatagagtgattgtaaagcgctggtcccatagcaagcatttggtgtagattggtctgaaaaaaacaaggaaagagggtgggagggaagaaaagaaagaaggcaggagagctctaagaggccctaacaggaatgaaactgaggtgtcaagagggctctctgtgcacacttttggccatgacccagtgtcttctgcagtccttacgcagccacatgaggacactcagcacagagcagcctgtgtgtcccagagagtgagagaactgaagtggtgtccccaaggccacccggcaagttggtggcagagccaatacctgagctacccttaggccccgtatgtacctgcttctcatgtgacgcacagggaaattgaggcctggccccacctccctctgttgccctgctggccacatgcccaggggaagggatttccagggcttacccagagtggcattgctggggagagaccagatgcctgggctcctgggtttccccaaggggacggcccttaggaatcctgtgcctcctccactgccacccccttcacagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctggtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4176 - DNA, 3259 bp, Homo sapiens
ctgggaattctgctgaagggtggaggattctgggagacagcaagggctgctggtacaaaggctgctaggtcagcaggaagagaagagaggaagaggctctgtcttgactgagggaaagttctcagaagaggtgtgtgaaccatgatcattggagagggacttggcctgtgtgacctaccctgcctgtccctggtttagcttagcattaagagcacggacacttcaaatttcagctctgttacttaccagcttgggcattctgtgagcatcagtttctttatctgttgagtagggtaatggcaacttgcctcatacagttattgttatctgtaaaagagttaggttagtgcaatacaagtttaaaagcaaaatgcaaaaccttgcctgtctgcctcagcaaatgttgtctgaaatgagaagtgtggggagtggagtagttcctggacagggtctggactcactcaggccacagggccccaggtggtagcctttttgccaccgtctcctccacccacaggaggataactgcccatcctccagcttcccggccggctggtcacacctcaccctcaacccaggacaggtcacacagctggagctatgggttggaataagggaattagcccggctgcccaggcctgcccaggaactgaggtgaacagatcgtctttgagaaagaggcttggggactggagacaggacaggtggggtcaatatggatctggggtgtctcctttgaggagggctccgatggtcccacatctggtaggtgctggacggtggacctagattaggtcaaagaatttctcagaagcagcggagtccagagttgagggcatgggtcctggcatgccgggctcacccctgcctcagttggcatgaaatgggcatgattgctagtccccatcttgcagggggatccagtgatagagtgattgtaaagcgctggtcccatagcaagcatttggtgtagattggtctgaaaaaaacaaggaaagagggtgggagggaagaaaagaaagaaggcaggagagctctaagaggccctaacaggaatgaaactgaggtgtcaagagggctctctgtgcacacttttggccatgacccagtgtcttctgcagtccttacgcagccacatgaggacactcagcacagagcagcctgtgtgtcccagagagtgagagaactgaagtggtgtccccaaggccacccggcaagttggtggcagagccaatacctgagctacccttaggccccgtatgtacctgcttctcatgtgacgcacagggaaattgaggcctggccccacctccctctgttgccctgctggccacatgcccaggggaagggatttccagggcttacccagagtggcattgctggggagagaccagatgcctgggctcctgggtttccccaaggggacggcccttaggaatcctgtgcctcctccactgccacccccttcacagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4177 - DNA, 1822 bp, Homo sapiens
ctggcccaggaggggctcggggtggacaccggctaatggggcactgtctgtggcagagcggagaccgcagcgcagagagcagaggcgctcaaggacttctcccgctcctcgtccagtgccagcagcttcgccagcgtggtggaggagacggagggtgtggacggagaggacacaggcctggagagcgtgtcatcctcaggaacaccccacaagcgggactccttcatctatagcacgtggctggaggacagtgtcagcaccactagtgggggcagctccccaggtaccaggacaaggcagcttccccacaaagcagggctaccttggggtaggagggggacagggctgggcaccagttcccatgccccatgcagtggatgtgatgtgactgcccctgacttggaggacagcgggcaggtcattgtccagcctagggtggctgggtggattggagggctggtttcttccggaagggtctcggaggataatgggggatggcaaggaagaaagttaagggtggggttggagcgcactggtgccgaccgcccacctatgcccccgtctccctggtgcctccccgcggccagtgaggtggctccctcctgcccccctccccaggcccctctcgatcaccccacccagacgccggcaagttgggggaccctgcgtgtcccgagatcaagatccagctggaagcatctgagcagcacatgccccagctgggctgttagccgggccaccccctctgaaggtgaaactgagcagatgaggccacagaagcacaaggggaaggtgccgtgtcaagcccaggcagacgagacctctgccctgaagaccaacaccagcccgtgggctgccccctgcctccccaccctccccatggcccacccatctgggctgtctctgcagggcagagccgtccagacctgggatcagggaagctgctggcatcgtccccacccccagcctgggggtctgggctggggcagggattgctcagtggaagcaggactgggggtctggcttgccccctccctgggcctccatcacccctgagcatccctctggactcagagggaacaaggtgggagagagagtttgagacagctccgtgtggagagcttagcccctggaggcagcacaaggaggatgtgatatgtgggggagtgagcactgggttgggagccgggtcctggtttccaatttgggttctgctgtgtgactctgggcaagtcactctccctctctgggcatgtctgctacaaatggacaagattatttcagaggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgccctgtccactgcctacacatgacagacaagtaaccccctcatgggggatggggacctacctggctcctcagccagcacccagcttaacccctgccatcccatgctgggccctccaggccaagagtctcagctggccgagagtccaggccttgcctcccccgaccgccatggagggggcagcccggcacagctgctgggagcccttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 4178 - DNA, 1999 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggtatggctggatctgggcacagctcactgagggtgggtgagtaactggaagactgagcatttattaagcaccttctgtgtgccagatactttcccaaggttctctcatttaatcctcacaataaccctgtgaagtccacaatttgcagaagaggagccaccgaaagggcctgtgccttcccccagggtgcacagcagataggagggcctgcgtttaagcctcggtttgtctgccttagaggctggcctcacatctggaacctctgtgatgtttggggaccctcctgagagcaagctgtgccatagtcctcccctggaatgggtgtcttttctaccggccttgcctttttatcccagaggagacctatagagagagaatagccctggcacttcctgctcggatgctggtagctgggctctaggcactgtgacagtgtggggataggggcacgggcttctgccttggatgagccaggggcacctcctggaagaggacagacaggtaaacccttgggtccctgactgaattctggagcagtgtgaggtggtgtggtccaggaaaggtatcctgaaggggcttcagaaatcagggcccccctcctgcttatgggagaggaaactgaggcctaaggtgaggaggagaacttgctcaatgcccacagcaaattggtgggacgtgtcctgttctgggaggatgatgtgggtttacagaggagccgaggagtgagttgggagttagagtggagtaggggtgggcttggcatggcaggactcggggctacactaagctaaaa

SEQ ID NO: 4179 - DNA, 1179 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtttggtgccagctgcggggcgcctgggcttggggaagaaaccttgtgtacgcacacctgcacacacacacagtctccggaggtgagcggccccctccctaccataacagaccccagcctgtgcaatgccctcggagtccttgttggggtcatagcacaggcccggtggtggggtcaggaagaacatccactgttctcagggctcattggcctctgtccccgggctccattcccctccctgccaagtcagaggtcaggcccctggggcggcaggcaggaaggacactgagggaaggggcactgaggcaggaggggcactgagggaagctggccaggtggaagtaggagagaaaggcaatgggggtgagatggtaccacttcctccccatatgaggctctcaggaggctcctggccccccctgcacaggtagtggtccctccttcctgagggtgtttgggggaaaacgctatggttggggcactggggaaggttgcctcgcagatgaaacagaacattggccaaaggtgtccctgaatgggcttctggactggcacagggccctgagggctgtggctgagtggggaggcagtgatcaggtccagctggccatgggggccccccattcccttctccatgacctcagcctc

SEQ ID NO: 4180 - DNA, 960 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagctatttcacctcttggaaccggcttctcatctgtataatggagatgacatttgtacctcctgggctgtgacgagattacgacacatgcgaagggcccagcattaagtaggtgctcaagaaaagccctctgtctgcaaggtaacccaaccctgtccttgatgccgaggcggggtacccagagcctgggaagatggagaaagtgaggtgggggcgcgctggggagaaccgagtggggggccccctcggggagcccgacgcacccaaagcttctagcgctcgggccggaacgcgcaggcgcgg

SEQ ID NO: 4181 - DNA, 1150 bp, Homo sapiens
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttggggtttggtgccagctgcggggcgcctgggcttggggaagaaaccttgtgtacgcacacctgcacacacacacagtctccggaggttaatacctctgccaaccgaggccaccctccctcggacccccattcggaggaagcagacccaagttcgaattctgacattgccactgagcagccgtacaacttttgggtggacaagtccttcacttctcgccggagtgtgtggaggagcgatgggcagaaccagcacttccctcaggcactagacctgtcacgagtgaacttagttccctcctatactccttcactctaccctaagctatttcacctcttggaaccggcttctcatctgtataatggagatgacatttgtacctcctgggctgtgacgagattacgacacatgcgaagggcccagcattaagtaggtgctcaagaaaagccctctgtctgcaaggtaacccaaccctgtccttgatgccgaggcggggtacccagagcctgggaagatggagaaagtgaggtgggggcgcgctggggagaaccgagtggggggccccctcggggagcccgacgcacccaaagcttctagcgctcgggccggaacgcgcaggcgcgg

SEQ ID NO: 4182 - DNA, 7128 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatgattttctagcagcacacgtgtttggaaagctactagaataattgaataattcagcacctgaggctggtggatgattctttgcaatttggcaggaatgggagagtcgggagcagtagttggcaaggtggggagtagccatatgaagttttatttcgggaatcctccaggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 4183 - DNA, 7004 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggcccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagggtatgaaatcaaggcttaggtgcaaagccattggataccatacctgagaccacacagccaagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 4184 - DNA, 5977 bp, Homo sapiens
gctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 4185 - DNA, 5999 bp, Homo sapiens
ggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 4186 - DNA, 6038 bp, Homo sapiens
gctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagggtatgaaatcaaggcttaggtgcaaagccattggataccatacctgagaccacacagccaagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 4187 - DNA, 2945 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggagtgagtcggcccagggcaccaggggtgtgggggtggtcatgcctcggtcctcttggggaagcctggaaggatgtggctcttagtcgagggccctgctcaccttgccctgtgggcactgccctggtgacacagcaggctgggcgggctgcttccaaggtctgttctccgatctggagctgagcctcctggagccctggcatggcaggtggcaggcgggcccagctgcctctcctagtccccgagggccagggtcacataggtgattccgctggatggacgcatgccccagtagatgggggggagcatctgtaatgaaagcaccaaaaaaaaaaaaaaaaaa

SEQ ID NO: 4188 - DNA, 2261 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgaggtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatttagaaaataaatgtctgactttcaaaaacccctgatgttttgagattgagtagccagtggctacagttcgttctggaagggcagagacctttggttgggtgatcaagcaaggatgatccttttttatttttatttttttgagacagggtctctctgttgtccaggctggaatgcagtggtgcaatcatggctcactgcaacctccagagctcaaatgatcttcccgcctaagactctcaagtagctaagactacaagaatgtgccaccatacctagctaattttttaatattttgagacagagtttctctatgttggtcagggtgatcttg

SEQ ID NO: 4189 - DNA, 4449 bp, Homo sapiens
tcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcactggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctacctttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcaggatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtccagacaccatcccaggtgtgtgtaagagagagagagagaacagggaggatacagaagtattgcagcccagatcccctatcagggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagca

SEQ ID NO: 4190 - DNA, 983 bp, Homo sapiens
agagagagagagagagagagagagagagatttgaatttcccatctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataaggtcagctccgcccgcccgcccgtcctggggagggccacaagcgggtaaaaccggtccagctaaagcccctgctggggctcccctggatcccagctctcaccttcgccctagttctgagcctcactcttctcatcagcaaaacgggtatcacaaggtcacctccctcaagggatccttttggggattaaataagagaatgcgcgtagtaggtactccaagagggtggaccctacggtccaccattccgtactgcagatctttgggaccaaaaatgagtgcagttctgaatttgggaatgttcgaaaaataccacagtgtcctaagcactttgtgctgtcagctgtcactcccagcgggtctggggctgccaccctactccagacagtccagtgcatgtctgttagtgcgtgcaataaataaaggctagaagtagtcttcca

SEQ ID NO: 4191 - DNA, 3302 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4192 - DNA, 3359 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcaggtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4193 - DNA, 3469 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagtaagtatgcattcgtcagcttttgcaaagaatatgttttttgccgttttgaaacttgaatagtggtgctcacgatagcattgatttattccttctttgcatttgaacaggttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcaggtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4194 - DNA, 3684 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcaggtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4195 - DNA, 2467 bp, Homo sapiens
aatacagtgaaatgcgtttggttctgagctgcagtagaggggctgtctccagttttgcaccatttgtgatttttaacacttactaccgtctgcctaatattagtgaaaaagttggtgtgtataaatgacattattgaacaaatgttgtttatttcaatttgacaggtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4196 - DNA, 2560 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttgtgtcagtgctacaatggagttctcttgtccacggagagcagtgttgcagtgtatggaatgctaaatcttaccccaaagggcaagcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtacactcacgtggaagctgagtgtcctttcctgacttttgacgacctcctgaaccggttggaggacttggtttgtgatgtggtagatcgaatattgaagtcacctgcagggagcatagtgcatgagctcaacccgaactttcagccccccaaacggcctttcaaacggatgaactattcagatgctatcgtttggctaaaagaacatgatgtaaagaaagaagatggaactttctatgaatttggagaagatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaatagatggagtttcgctcatgtcgcccaggctggagtgcaacagtgcaatcttggcctaccacaacctccgcctcccaggttcaagcgattctcctgtctcagcctcctcagtagctggattacaggcatgtgccaccatgcccggctaattttgtatttttagtggagaccggtttctctgtgttgctcaggctggcctcaaactcccgacctcaggtgatctgcccgcctcagcctcccaaagtgctgggattacaggcatgagccacggcacccagccacaatgggcacatttagtcatgcagtataagtgaagaatggaggtcactcagaagacacagtttttcattacctacaaagttctacatcaatccgccctggttcccctacctctcgccgcccccctactcaagccatgtggcctccctgctgttctttgacagccttgttatggggctgagttgtgttcccccaacagacatgttgacatcctagcccccaggtacctgtaaacatgaacttatttggaaacaggggtctttgcagacgcagtcaggttaagatgaggttattagagtaggcctttaatccaaaatgactggcgtccttccaagaggagaagacaggctgtgactgtggag

SEQ ID NO: 4197 - DNA, 2769 bp, Homo sapiens
ctcgggagcccgaggtgagattataggcatgagccacactgtgcccagcctatgaattcagtttatgatgtataatgacaaaattttgtattgagaacttgcatacttttagtgttcctaatacttagtaaaatagtgtagttgagtggaaagaacacaagctgtggagtcagaaggccccccaggtgggcttagctcccacctcttttcttttgtgctgtgtaactgaagaccagtgaccccctctcaggttccttatctctaccttggaagtaacatctgttttgcaagattgtggggactaccggagctaaatgcctaggcaggacaatggcagggggagcctgtcagcatttactatacattgctactgttccacacacatgaggacactagagtggatacatgaccctcaggctttggggggtatgaaataagacctgttttcccctaactaaatcttatgcagaaccccgctgtgtaaagcagatgcaagctgagagactagagctctcccactcatctcctgttacctctcggcgtctccgaggacgcaagggctccagagcctggagcttgaaaacaggtgtgctaggtgattgctacctccatttcacttcttcattaaacaaatctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgcttcagagctagacaaaacgggccactgagaaaaatactgagctgtgtctagtcacagcttggggctggcttttgtttttgtttttttttttattttccttcatcaaacagcatggtgcttgagatatgctgtaaagggagacagatcttttatgcttcattaaataactgagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4198 - DNA, 2718 bp, Homo sapiens
ctcgggagcccgaggtgagattataggcatgagccacactgtgcccagcctatgaattcagtttatgatgtataatgacaaaattttgtattgagaacttgcatacttttagtgttcctaatacttagtaaaatagtgtagttgagtggaaagaacacaagctgtggagtcagaaggccccccaggtgggcttagctcccacctcttttcttttgtgctgtgtaactgaagaccagtgaccccctctcaggttccttatctctaccttggaagtaacatctgttttgcaagattgtggggactaccggagctaaatgcctaggcaggacaatggcagggggagcctgtcagcatttactatacattgctactgttccacacacatgaggacactagagtggatacatgaccctcaggctttggggggtatgaaataagacctgttttcccctaatagagctctcccactcatctcctgttacctctcggcgtctccgaggacgcaagggctccagagcctggagcttgaaaacaggtgtgctaggtgattgctacctccatttcacttcttcattaaacaaatctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgcttcagagctagacaaaacgggccactgagaaaaatactgagctgtgtctagtcacagcttggggctggcttttgtttttgtttttttttttattttccttcatcaaacagcatggtgcttgagatatgctgtaaagggagacagatcttttatgcttcattaaataactgagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4199 - DNA, 3094 bp, Homo sapiens
ctcgggagcccgaggtgagattataggcatgagccacactgtgcccagcctatgaattcagtttatgatgtataatgacaaaattttgtattgagaacttgcatacttttagtgttcctaatacttagtaaaatagtgtagttgagtggaaagaacacaagctgtggagtcagaaggccccccaggtgggcttagctcccacctcttttcttttgtgctgtgtaactgaagaccagtgaccccctctcaggttccttatctctaccttggaagtaacatctgttttgcaagattgtggggactaccggagctaaatgcctaggcaggacaatggcagggggagcctgtcagcatttactatacattgctactgttccacacacatgaggacactagagtggatacatgaccctcaggctttggggggtatgaaataagacctgttttcccctaactaaatcttatgcagaaccccgctgtgtaaagcagatgcaagctgagagactagagctctcccactcatctcctgttacctctcggcgtctccgaggacgcaagggctccagagcctggagcttgaaaacaggtgtgctaggtgattgctacctccatttcacttcttcattaaacaaatctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgcttcagagctagacaaaacgggccactgagaaaaatactgagctgtgtctagtcacagcttggggctggcttttgtttttgtttttttttttattttccttcatcaaacagcatggtgcttgagatatgctgtaaagggagacagatcttttatgcttcattaaataactgagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactct

SEQ ID NO: 4200 - DNA, 917 bp, Homo sapiens
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctagcagagctgtacgtctctgaccgagagggaagcgatgccacgggagatggaaccaaggagaaaccatttaaaacaggtctaaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttggtaaatattttctcttatttatgcctgaaaattagatgttttcagtagattcctttattgttttgtatacatttatttaaaacatttattat

SEQ ID NO: 4201 - DNA, 710 bp, Homo sapiens
tcggccttccaaagtgctgggattacaggcgtgagccaccgcgcccagccaaccagtgtgcttcttaaatgttcaaccagtcactgtgccaatatcagcttttggctgttggggtctttatgcttagattgttccagttgccttatacttgagatgttattttgattttaagtattgtacaatgttcaagaactgtcttttctctcctccctacccaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggcagaagatagtttacgaagagaaaagaacctggaagaagcaaagaagattaccattaaaaatgatccaagtctcccagagccaaaatgtgtgaagattggtgcgttagaaggatatagaggccaaagagtaaaggtgtttggctgggtccacaggctgcgcaggcaaggaaagaatttaatgtttctggtgttgcgagatggtacaggttatcttcagtgtgtcttggcggatgagttggtaaatattttctcttatttatgcctgaaaattagatgttttcagtagattcctttattgttttgtatacatttatttaaaacatttattat

SEQ ID NO: 4202 - DNA, 3236 bp, Homo sapiens
ccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacaggaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctggagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatga

SEQ ID NO: 4203 - DNA, 3173 bp, Homo sapiens
ccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatga

SEQ ID NO: 4204 - DNA, 3682 bp, Homo sapiens
ccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatataggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatga

SEQ ID NO: 4205 - DNA, 1047 bp, Homo sapiens
ccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaacatg

SEQ ID NO: 4206 - DNA, 1341 bp, Homo sapiens
ccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcaacggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtgg

SEQ ID NO: 4207 - DNA, 1513 bp, Homo sapiens
ggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttaggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaacca

SEQ ID NO: 4208 - DNA, 1898 bp, Homo sapiens
cgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaacca

SEQ ID NO: 4209 - DNA, 1575 bp, Homo sapiens
cgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatgaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcagcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaacca

SEQ ID NO: 4210 - DNA, 1953 bp, Homo sapiens
cgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccggatggtggtttcgatttatccgatgcccttcctgacaatgaaaacaagaaacccactgcaatccccaagaaacccagtgctggggatgactttgacttaggagatgctgttgttgatggagaaaatgacgacccacgaccaccgaacccacccaaaccgatgccaaatccaaaccccaaccaccctagttcctccggtagcttttcagatgctgaccttgcggatggcgtttcaggtggagaaggaaaaggaggcagtgatggtggaggcagccacaggaaagaaggggaagaggccgacgccccaggcgtgatccccgggattgtgggggctgtcgtggtcgccgtggctggagccatctctagcttcattgcttaccagaaaaagaagctatgcttcaaagaaaatggtcagctggcaggctctttgggaccttgtattcggatccgccgtgaagctgggaaatggctgaagacctaggggtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacactcagaacaaggggaggtggacatggagagccaccggaatgccaacgcagagccagctgttcagcgtactcttttagagaaatagaagattgtcggcagaaacagcccaggcgttggcagcagggttagaacagctgcctgaggctcctccctgaaggacacctgcctgagagcagagatggaggccttctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccccagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaacca

SEQ ID NO: 4211 - DNA, 1160 bp, Homo sapiens
ctgggctgagtttgcagggctgctcccctcacccaaccccttcgagtcctccgcgggctccgccccacccggcccgtgggggaggttccgtcccgccgccttcgcccgcgcgctgcactcgcggacgatctctgctcgccttgggcgcgccgtggcgcgcggggccgtgctggcgctgcggctcctcggcctgctccgccgtctggtggccgccccgggctgactttgacttagcgatgcctttcctgatggaggaaacagtgacccagcaccacctaatgcccccaaaccaaagccagatccaaaccccaaccgacctggtttcactggtgacccagcaccacctaatccccccaaaccaaagccagatccaaatcccaactgacctggtttcactgataagagcctctaaccctacggggtggtctctatgttgtttacctggcagtgatgtccgtgtcatctgagaagaggagatttcaggggctgactttgacttagcagatgcctttcgtgatggaggaaataacgacccagcacctcttaattcacccaagctgaagccaaatgcgaaccctgagcagcctggattcattggggatgactttgacttagcagatgccttacatgacaaaggaaactacgagccagcaccactgaacccacccaaaccaaagccaaatccaaaccccaagcagcctgattccaccggggatgactttgatttcacagatgtttcttcatggtgaacgaaacagcaccctgggaccatcctggctggaaggcatagtgacattgctggcctgagctgaagtgccgattaaaataaattgaaagctgaattaccttatgaacagctgctttacccaggaacaaatgtggagaggaactccttgaaactgtgttctcaagtagaccacttttgagaaattatacatttatcataacatctcaagtcctgctctacatagaatgaccattattatcaagaaaagttctccattccctgtaattcataaggcaatgcaggcctaaccagaaaacaggaactgcgacaaccttgcatcagacacattcgatctctctattcatagttgcattctctttttttttgtttacaaagccaatcaccaataactcggaaaacaaaaacaaaaaaa

SEQ ID NO: 4212 - DNA, 6659 bp, Homo sapiens
tgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 4213 - DNA, 6333 bp, Homo sapiens
ggctgcagtggccgccgctggagaccgcgggacctggcgctgcagcgagattttcaaacaccgcattccccttaaacctcccaggctcccatcactcccagcaaagagccagcccgctactttatggagacaggagagactgtcagacagttcctgctgctgcccaggtgcatctgagagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 4214 - DNA, 3580 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgag

SEQ ID NO: 4215 - DNA, 1786 bp, Homo sapiens
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 4216 - DNA, 6703 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctgaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggcgcatactcaatacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 4217 - DNA, 6951 bp, Homo sapiens
ggtgcccctccttccctccaatctggtgagcctgttctcccaggtttcctgcagctgatggatgtcacctgtggagcctggctgtggggtggtacagctgccgctggggtctccttacctgccccacacacagggagggagacctgagtggcggatggacatagtttaagggccggtgttgcaaacttatgaaaagaaaagaattttgagtcagtaacatttttgcaggccccataagcagatcgcctccccaccgcccaaatcccgagtcctttccttttcccacaggttttaggaagtggcagcctgctcccagggctgcttgttgaggaagctgcctcccacactctttctccttactgcctctgcagggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctgaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggcgcatactcaatacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 4218 - DNA, 7144 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctgaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggcgcatactcaatacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaagcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttaggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 4219 - DNA, 7291 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctgaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggcgcatactcaatacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaagcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttaggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgggggctgagcgtgtagcttctacttacatacctccagtggtggggaattcgctacctcccaagcatcacagttctggaagcaccgacctctcctcttcatgccttcaagcacccttccaggctggccaggaagttccggtggcccagtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 4220 - DNA, 7130 bp, Homo sapiens
caagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctgaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggcgcatactcaatacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacggcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttaggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 4221 - DNA, 4684 bp, Homo sapiens
tgaagtcaaaatcacttcaaatcccttgaggtctctctgggaatccagaaccacagaatttccgaacctcagtctgtttttggtttttgtgtgtgtgcttattgttttgttttgttttgttttgttttgagacggagtctcgctgtgacatccaggttggagtgcaatggcacagtctcagctcactgcaacctccgcttcccaggttgaagccatcctcctgcctcaccctcccgagtagctgggattacaggcatgtgccaccacgcccagctaatttttgtatttttagtagagatggggtttcaccatgttggccaggctggtctcgaactcctgacctcaagttgatccacccacctcggcctcccaaagtgctggggttacaggcgtgagccaccatgcctggcccagaacctcagtctgaatcttctgtttgacacagaaattgaagccaagatgagaaactggagtgataatataaatagatgctgtttcgtttcagagacggggtgagagcacaggcagggttctcttcatgtcacaccaggatgccctcggtgtccagctcgctgtgatgttattgcttactctttaaatgcactgatttttaatcaaacagcctgctctcctctgccctctccacctcacccagattactcagtgccagggaggagtcaagggaatgccagcttatttcactgattattaactttagcagaaaatgagattcatggaaatggctttttgacagaaaaattgccaactaaattaagcacggcatcacttccttcatcctgggagactagagtggatttctgtcacaatgcacatggctctaccatccccagccctgtgccaaactgagaattaagttctagctcctgagccccaaatatgattaccatggtcatgagcgtcattgtcctgaaccccacgtgagtggcctagcttcccagactggggaagaacatcccagcccatgttagggaaccagggacccactgggggtgtgtgggagggctggctatgtcctaaacatctacttctaaccaggaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaagcacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttaggggagcctcaggatatacgtgcacatgtccttgggccaggatgtccgtactaagccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 4222 - DNA, 3362 bp, Homo sapiens
tgttgtggccaggtgggcaggtgccctcagcaccataaaccttgatttttttcctttggggcagatgtaaatttgaggcaaatgacacaaagaagctgaagaatagcaaatgtccaggagaagggagtgcccccttccttcccaggcccctggcacctgctccctgtgggtcccctgacgtgacaccttcaggtgcgtgcccttacatgtgcgcacacatggccctgaacggtcctcatctctcttcccgtggcctcggcctcggctgtccacatgtgttccagaaagctctgtgcagtaatagaggagggccccccgcaacctcaacctctggttcacccagcacagccttttttttgtctgccctctatactggcgttctgtgtgagatttcctttgtgaagttgtttgaagctgcagccccaggcctcataaatgtagataagcagagtatcatctgttgatggctgcttgtgctgtgcccagcactccgttggtgaagtgaggcttcctcactggagcgcagagggagtcccagagctcctccttcctgagggcgttgggcttagctttggcatgggattgttttgctgcatcgtttttcttagatggctcatctgggatatacctggtcattggctttttaattttaacactgccatttcctttcagtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 4223 - DNA, 2745 bp, Homo sapiens
tgaagtcaaaatcacttcaaatcccttgaggtctctctgggaatccagaaccacagaatttccgaacctcagtctgtttttggtttttgtgtgtgtgcttattgttttgttttgttttgttttgttttgagacggagtctcgctgtgacatccaggttggagtgcaatggcacagtctcagctcactgcaacctccgcttcccaggttgaagccatcctcctgcctcaccctcccgagtagctgggattacaggcatgtgccaccacgcccagctaatttttgtatttttagtagagatggggtttcaccatgttggccaggctggtctcgaactcctgacctcaagttgatccacccacctcggcctcccaaagtgctggggttacaggcgtgagccaccatgcctggcccagaacctcagtctgaatcttctgtttgacacagaaattgaagccaagatgagaaactggagtgataatataaatagatgctgtttcgtttcagagacggggtgagagcacaggcagggttctcttcatgtcacaccaggatgccctcggtgtccagctcgctgtgatgttattgcttactctttaaatgcactgatttttaatcaaacagcctgctctcctctgccctctccacctcacccagattactcagtgccagggaggagtcaagggaatgccagcttatttcactgattattaactttagcagaaaatgagattcatggaaatggctttttgacagaaaaattgccaactaaattaagcacggcatcacttccttcatcctgggagactagagtggatttctgtcacaatgcacatggctctaccatccccagccctgtgccaaactgagaattaagttctagctcctgagccccaaatatgattaccatggtcatgagcgtcattgtcctgaaccccacgtgagtggcctagcttcccagactggggaagaacatcccagcccatgttagggaaccagggacccactgggggtgtgtgggagggctggctatgtcctaaacatctacttctaaccaggaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggtaggggcggccgtcctggccgtggtcgggtgaggaagggggtgtcctgaagggtcccgcaccggtggctgtgcacacgtgtgcaggaacgtgccaggggtgggtgactgcatgtgcgccttcgcttagatgtgttacgagccaagtagaaattcagcgtggcgaccgttttgtcccataatgcttttgttactttattttatattttattttaatttttttgagatggagtttcactcttgttgcccaggctagagtgcagcctggctgcctcccaggttcaagtgattctcctgcctcagcctcctacgtagctgggattataggcgcccaccaccacgcctggctaattttttgtatttttagtagagacggggtttcaccatgttggccaggctggtctcgaactcctaacgtcaagtgatccacccgcctcagcctcccaaactgttggattacaggcgtgagctgccacgcccaaccacttttgttgttttagaacaaaaggtatcattcatcatgtagccgggcagatatctcaatatccaaagctgacattcgtgcaggtaccatagagacaagcgacatagcttattttgggctgcctcgtatgtgccagatttgtagaaagctgctttgtgcagggagatcccaggtgcactcaacacgttctccatgtatataagacctcccgaaagccttgggtggtttatctgttaccactttgaaaggtgggttaggacttcttcagcctgatctggccttgtgtcccaccagccacaggacacactgtgccttttccctaagggctgtcctttggagtttgccagaggttctgaaacaagaacaggatttctcatcatgtatgctgtatttcatcaactctcaggagccatgaaagctgcacagttactttatataccacgaggcaatcaaacggtacagggccaccacttcgaatttttcttacgctcttgttgaaagagcttttctaaataagaattcgatttttgtacacacacgtaaaaggaaaataggaccaagatgagttggttatgaccatgtcagttttgtcaccgtggccacctggccagtggtgactgagacatcactgaaattgcctcctaatttccaagacgttaaaggtgtcttagaatcgattagacacagcatttaccttacacattgttaaattttcagctttacctttaaatatcattttggggagattatttatcccaggcctgcatcccaagtcatttaaatttttacaaaggacactaggactttctgaagacccagcctatgcctgagacccatggggtcttggaggcggaggatataacactgaagaccagcgacaggctaccctctgagtgtggtgtgtgcacaagcctttcagggggcacattcacaagtacctgttgtgtccccttcagatgcaaaaaaa

SEQ ID NO: 4224 - DNA, 1820 bp, Homo sapiens
ggtgcccctccttccctccaatctggtgagcctgttctcccaggtttcctgcagctgatggatgtcacctgtggagcctggctgtggggtggtacagctgccgctggggtctccttacctgccccacacacagggagggagacctgagtggcggatggacatagtttaagggccggtgttgcaaacttatgaaaagaaaagaattttgagtcagtaacatttttgcaggccccataagcagatcgcctccccaccgcccaaatcccgagtcctttccttttcccacaggttttaggaagtggcagcctgctcccagggctgcttgttgaggaagctgcctcccacactctttctccttactgcctctgcagggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggtagggagccttgctgtgaggcccctggatggggctgctggaaattcctgagaagcacattcagactgacctgtccttgggggcttggaggagcggagccacagctgtttcagcagatgcttccccggcacctcagcctgcctgggcttcccagggcccccgtcttgctcctcttcatctcccagtcagcaggggagggtaaggagtgtaattgattgatgtaaggcagtgattcagggtttctcctgcccccacctcatggcattatgatcaccttctatccgtgtgcgtcttttaaaagacttcttgcaatttctgtggctaatttgctaggactatttcctcatctgtgggaataacgggcaaccgggtgcagcggctcacgcctatattcccagcactttgggagaccaagggtgggaggatcgcttgaggccaggagtttgagatcagcctgggcaacatagcaagactctgtctctacaaaaaataaaaaaatttagccaggcatagtgccacgtgcctgcagtcccagctactcaggaggctgaggcaggaggattgcttgaacctgggatgtcaaggctgcaatgcattgagctatgattgcactgctgcactccagcctaggtggcagagaggaaccctgtccctaaaaataaaataggaattattgttatggctctatgaggtttcaaagatgtaactggtgttgggcaagccccatagccatcagctagtggaggctactctatctttattttaaatcttatcaaggttctgggaaaaatgtaggtgaaagggtcaaggctacatggagacccagacccaggtgaggtctctgatgctttgaccactcaccctgacaacctcatgtcagtagcagcttccgggaccctcttttctgaggatttaggaatttttcccattgcctattccaaggggggctggaagtggttagaaaacgtgagctgagtgaaatcagaatactggcacacattgagtggacttgttcaaggctaagaaataatcccaacgtctctcctaccagccagaaggcctcttaggccaccgaaggcagagcaccgtattgccctctccctgccgtggagctgtcgggcttgccggggaaggctgtgagcccaggatctctacgtgttctgtgctgcagccggggccctggaggctctggaagctctgagtgactg

SEQ ID NO: 4225 - DNA, 1096 bp, Homo sapiens
cgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcactcattagaagaattcctcaattgctgcttcaacacccgccacgatggcgttcaacctggcagattaatttaacaactctctgatgggttgccctgaaatttgaaaaacagtgccttgggctgggcgcgatggctcacacctgtaatcccagcattttgggagaccgaggcgggcgaatcacctgaggtcgggagttggagaccagcctgaccaacatggagaaaccccatctctactaaaaatacaaaattagcggggcatggtggcgcatgcctgtaatcccagctactcgggaggctgaggcttgaacccgggaggcggaggttgcactgagccgagatcacgccattgcactgcagcctgggcaatgagcaaaactctgtc

SEQ ID NO: 4226 - DNA, 746 bp, Homo sapiens
cgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggtcctgaaggctgaccgaaacaataacagaggcagtaatagtagtcagaggttctatccatggattttgtttatcttgtaaaagagagacaacaggccttccagttgtccagggtctcagccagtcttcgactccatgttagtgtaaaacttctgcaccccatccatttccacctttcctctcctcccctataccttttt

SEQ ID NO: 4227 - DNA, 3723 bp, Homo sapiens
attgagctaagaggagctgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccagctgtcctgggggaggtggacacctcgttggtgctgagctccatggaggaggccaagcagctggtggacaaggcctacaaggagcggcgggaaagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactgatgtgctgacgcccgcccagctgaatgtgttgtccaagtcaagcggctgcgcctaccaggacgtgggggtgacttgcccggagcaggacaaataccgcaccatcaccgggatgtgcaacaacagacgcagccccacgctgggggcctccaaccgtgcctttgtgcgctggctgccggcggagtatgaggacggcttctctcttccctacggctggacgcccggggtcaagcgcaacggcttcccggtggctctggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtaagcaggacctaggccaggagcgagtgggctgacagctaaaggtggggtagggatcaccttggctctagggagctagggtggggagcagtctgctttcctcccatcttggagatctggtctgactctctagcctcagttcctctgactctgcttccatatctgataataaacagtggggtggggatggccctcagagggaactggctacttcctatgtgttgtggctcgctgtgacccaggaagccagggcctgggagcatcccaatcttgcaagtctgaatggcataatctcctgagacctatatgtccctggggtcatgtagtgaccggtgaggacctgctcactggggccaccaccttggcaccaggcactgcttgtgcccagccctcttctcgaatcctcctgaccctacctggacttgtccctgactccaatctgagctctgatactgagccagatacttcccctgacctggctcctctggtccccaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatgggga

SEQ ID NO: 4228 - DNA, 3093 bp, Homo sapiens
ggcctttctaggggcgatgctgtctctccctcagcatagggagtgggcccttccacctctggcctctctcccccagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagagggtaagttctccctgggaccccaggaaggagttgtcatccttattctatatgctgagtgctgtgttttacaggcaggttttggatatcagatataatgaacattcatctttggagagtgagtagagaatgaggggccctgtcagctgccacagccacacatcaaggcctctgggggctttgggctggctgaggactggtgctcctaaaactgagccctgggccaggggcatatgcttatcagagaaacacagcaggctgtgtgcagcttgacctgaaggctactgcggtctactgatatgtctagggtccctggaggcctctggagccataggtaccactcacacaggaggggtcactctggagcacacactcagaggccagcagccctgcaagtcttctgagatcaacctgactgtctctgggcctgtgccaggggacatgaaatactttgatgggcctctgttaccacagctccagtttcctggtggctgaggttggtaggtgtaggcagacacgctgcagggccaggggaggcaaagcattcaggacacatgtgcgtgtggccttcttgcccctgtttgcctggaggggtaatattataaatattccttctatggtcttctctctcccctgcaaccctaggaaggttttcctgattccccactccttatcgcccagtccagtaaaagcatggcctctccgctcccctccctcctcaagagtccggtggtgatgagccatgtttccctgcaccaggctgagggccttccattcacactgtgcctttgcagatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttca

SEQ ID NO: 4229 - DNA, 4221 bp, Homo sapiens
gcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaagactc

SEQ ID NO: 4230 - DNA, 3577 bp, Homo sapiens
attctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaagactc

SEQ ID NO: 4231 - DNA, 3154 bp, Homo sapiens
ggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacaccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaagactc

SEQ ID NO: 4232 - DNA, 3202 bp, Homo sapiens
gggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaagactc

SEQ ID NO: 4233 - DNA, 5239 bp, Homo sapiens
ggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaagtgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttcttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaagactc

SEQ ID NO: 4234 - DNA, 4312 bp, Homo sapiens
ggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaagtgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttcttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccaccctgcccacccccgggatcctgcccccaagtcatttccgtcccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggcgagacagtttactttgccgacttgccatgtttttgccaaaaccaagattttgaaggaaatgagtggccagcgccagggcccaggccatgtggcctgcccagcctcaatgtcacttggcggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaagactc

SEQ ID NO: 4235 - DNA, 1372 bp, Homo sapiens
gccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctcc

SEQ ID NO: 4236 - DNA, 1791 bp, Homo sapiens
gcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctcc

SEQ ID NO: 4237 - DNA, 1225 bp, Homo sapiens
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 4238 - DNA, 1210 bp, Homo sapiens
tgtctctgagagcattgatgaggtcaggaagcctcctgttgggtagaggagcaactaagagactgaacttggcccccaccctgaggctcacaagcttgaattgcacctgagttccaaaggagaagttgacattcttccagaacatatgcccagtgtcttcaacttgagatggagctgggatgccaagtctgcaaatactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 4239 - DNA, 1192 bp, Homo sapiens
cttggctggaggctctgcgaggacagctggggagaaggggagctgtgcccagatttaccaaagggaattgtcagctgtccaagggctagcaaattcctaggtcacctagattggattttctgaccataaaaactgtgggccaggtgcacagctgcctgaggggctcaaacctgtgcagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 4240 - DNA, 1177 bp, Homo sapiens
cttggctggaggctctgcgaggacagctggggagaaggggagctgtgatggaggctcgctctgttgccaggctggagtacagcgatctcggctcactgcaacctctgcctcccgggttcaagtgattctcctgcctcagcctcccaagtagctgggactacagactgcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 4241 - DNA, 1051 bp, Homo sapiens
gccttatttctctgctggttgagcgaagggattgtcttccatggtctccgagatcccgtcccacgctcatgccctagaattctctgagtccttgatgcacttttgcctttggcgaggaggcaggacagtcaggcgtggaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctaggcccctgccgctcccacccccacccatctgggccccgggttcaagagagagcggggtctgatctcgtgtagccatatagagtttgcttctgagtgtctgctttgtttagtagaggtgggcaggaggagctgaggggctggggctggggtgttgaagttggctttgcatgcccagcgatgcgcctccctgtgggatgtcatcaccctgggaaccgggagtggcccttggctcactgtgttctgcatggtttggatctgaattaattgtcctttcttctaaatcccaaccgaacttcttccaacctccaaactggctgtaaccccaaatccaagccattaactacacctgacagtagcaattgtctgattaatcactggccccttgaagacagcagaatgtccctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 4242 - DNA, 2878 bp, Homo sapiens
ctgtgttaggatggtctcgatctcctgacctcgtgatccgcctgcctcggcctcccaaagtgctgggattacaggcgtgagccaccgcgcctagcaatatactattttttataactgtttattacttcctcccatattgcaaaattgatctttccaaatgttgcaaaagggggaaatagttcatttatgtaggtagtacacacactttatatgtttaagtacttacaagcatagtgaatttaagatcaaagacctggtttcaaatagaggcaacactacacagtaatttggaaactgaaaaagtcatccagtttctgtaagcttccttttgcttgtaaaaaacagaatgagctgtcttttaggttcacttttcagcatcctggtacatgagctgaagtgcatgatggcacatttaggttattcaagcattgtgatattaagaaggttcctggtgctttgatgagctttgcatcctaactgagctcctaaaaattctaagatgaaagttacagacattatgtaatttttttgtgtgtcatagtcttgggggttgttaatgaagaaataagactgtgtcatctgtatgtgaaattgatacaacttacctttgcagcattctcccagcaatccttatgagccccattgtgccccatgtgagcacttttcccagacaggcctgattctccctatgagtgctcacagccttctcctctccccacatgccacattccttccctctgccacgccatgcccgtctctgttcttcagagctacgttagatgccaccctctccaagaattcttcccaagcatctcccagttggaatatgttcacccaccactgcacgctgcacgttgatgtcttcacctgcgatttctgtggtctgtctgtgtagtctctaccacttgatgagctccggggcccaggaccatatctgagttccgtttacttaatggaagcctaagtgttcaaaattcacccacaaaactaaagttgtcaccaaggaggtttgcttttgcttttgtttttctacctacaataggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacggggatgagtgccacctctcgtaaacggaaagaagaattagctgaagcattgaaaaagcttattttatctaagggcaaaacaccagctctaaaataccagcaactttttgaagatattcggggacaatctgacatagcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaaccttta

SEQ ID NO: 4243 - DNA, 1314 bp, Homo sapiens
gggaagtaaaaatactgcttattaaaaacaaccacgaacccagcattgagctagaagcacagcagctccatttcaccctcagggtgactgtgcccgtgggcatgctcacgtagctacagttgccctggagcactgctgactagtgggcccaggtgaacacgtcctcgggtctatcatttgcagaaacctgggttctttctcttttgttttgttttgttttgttttgtttcattttgttttgttttgtttttgagacggagttttgctctcgtcacccaggctggagtccaatggcaccatcttggctcaccgcaacctccgcctcccaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaaccttta

SEQ ID NO: 4244 - DNA, 2334 bp, Homo sapiens
gtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatgaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 4245 - DNA, 1836 bp, Homo sapiens
tgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 4246 - DNA, 872 bp, Homo sapiens
ttcagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 4247 - DNA, 1375 bp, Homo sapiens
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaa

SEQ ID NO: 4248 - DNA, 1602 bp, Homo sapiens
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctgctatgctgggactcatgtatgtctactggactcagctcaacatgttccagaccttgaagtacctggccatcttgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaagattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttg

SEQ ID NO: 4249 - DNA, 867 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4250 - DNA, 956 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttacccttgcgtcctggcttccgaatgatttctgttcctccttggcttagtgggacaccagccattggaagatttgctcacggtcaacctct

SEQ ID NO: 4251 - DNA, 882 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4252 - DNA, 1455 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4253 - DNA, 1272 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4254 - DNA, 1027 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4255 - DNA, 853 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgagccctgggtactttccagggccagctgccctcacgctgggggtccagccatcccctgcccagttcagccgctggatccagactggggccatctgtggcgctcccccgctggagggatagtcaggagcagcagtgctgtgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4256 - DNA, 824 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatggccagctgccctcacgctgggggtccagccatcccctgcccagttcagccgctggatccagactggggccatctgtggcgctcccccgctggagggatagtcaggagcagcagtgctgtgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4257 - DNA, 699 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4258 - DNA, 971 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttacccttgcgtcctggcttccgaatgatttctgttcctccttggcttagtgggacaccagccattggaagatttgctcacggtcaacctct

SEQ ID NO: 4259 - DNA, 1288 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4260 - DNA, 1238 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4261 - DNA, 858 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4262 - DNA, 1327 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttacccttgcgtcctggcttccgaatgatttctgttcctccttggcttagtgggacaccagccattggaagatttgctcacggtcaacctct

SEQ ID NO: 4263 - DNA, 1826 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4264 - DNA, 708 bp, Homo sapiens
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaattta

SEQ ID NO: 4265 - DNA, 1952 bp, Homo sapiens
cccgccttccgggaaggacaaacacgggaagaggtcagtgcccgagccacccccaccgccctccctcggggcctcattgctgcagacgctcaccccagacactcactgcaccggagtgagcgcgaccatcatgtccatgctcgtggtctttctcttgctgtggggtgaggcctcctggggtctgggtccctggggcgggagggggcgggaacaggagccttacgggggctgtctccgcaggtgtcacctggggcccagtgacagaagcagccatatgtgagtgcaggggtgaggtctgggaatggtgggcccaggccgggggggagccctgtctctgtggcactgagctgatcccagccaccccttgcagtttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgttta

SEQ ID NO: 4266 - DNA, 2547 bp, Homo sapiens
cccgccttccgggaaggacaaacacgggaagaggtcagtgcccgagccacccccaccgccctccctcggggcctcattgctgcagacgctcaccccagacactcactgcaccggagtgagcgcgaccatcatgtccatgctcgtggtctttctcttgctgtggggtgaggcctcctggggtctgggtccctggggcgggagggggcgggaacaggagccttacgggggctgtctccgcaggtgtcacctggggcccagtgacagaagcagccatatgtgagtgcaggggtgaggtctgggaatggtgggcccaggccgggggggagccctgtctctgtggcactgagctgatcccagccaccccttgcagtttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcggtgactgtgggaaccatctctgggggctgctgggggaggaggatacagggggcatgaccacattcatcctgacctccatgctgaatgtccttgcccaggaccaggtccaggaagctggccacacggttgcctgggtctgatggttgcaaaggagtttgggcagaggatgcccaaagaatggaagggtgaggccgggtgcagtggctcacgcctataatcccagcactttgggaggctgaggccagcggatcatgaggtcaagagatcgagaccagtctacccaacatgacgaaaccccgtctctactaaaaatacaaaaattagccaggtgtggtggcaggtgcctgtagtaccagctactcaggaggctgaggcaggagaatcccttgaacctgggaggcagagcttgcagtgagctgagtggcgccactgcactccagcctgggcaacaagagcgaaactccgtttcaaaaaaaaaaaaaaaaaagaatggaagggtgttcctgggattgccacccggagggcagaggtctggggactgggcagagggcagctccagggatggggcagcctagtaatgctgcctgcattgcagctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgttta

SEQ ID NO: 4267 - DNA, 2664 bp, Homo sapiens
tacccaggctggtctggaactcctgagctcaggcaatccgcctgcctcggcctctcaaagtgctgagattacaggtgtgagccactgcgcccggcaccttaaatacacttttaaagttaaacttatggagggaaaaccctcatctattgacatagattgtatgtccttttttggtccctccatgaaggagcaccgttttctccatcatttcttcttcccttcacccgtcagagtgaccgaggctggggaccccagaagccccagagcaggcccgaatctgggacttccacggtcctgggggaggggtgcggggacactcacgtgtggcgcggatgtccggggtgtgaaggcagcgggcgcagctcggcggcgccggaggagccctctgcgcccaggaacaagacagggaagatgaagccggggctgaggcgcaggcgcgggcgcggcctggggtgtggcctggggcgtggcctgggcgcggcctggggcgtggcctggcccgaccacccgcccgctccgcccaggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgtttaaaatgtctttggactcccagggctgagtgggctgggatctcgtgtcctcaaagtggatgggttctggggtggctcctgaggtagaggagtggagaactggctcttaagagcacagttttcttttcttttttcttttttgagacagggtctcacactgtcacccaggctggagtgcagtgttgcagtccggctcactgcagttttgacctcccaggctcaagcgatcctcctgcctcagcctcccaagtagctgggagcctgggcatgcatcgccacgtctggctaattattattttttgtagacagggtctcactgtgttgcccaagcttgtcttgaactcctggccttaagtgatcctcccacctcagcctcctgagtagctgggactacaggcatgagccaccatgcctggccaactcacatttttctttctattatttattttttgtagagatgagtctcactatgttgcccaggctggtcttgaactcttgggctcaagtgatcctcccgcctcagcctcccaaagtgttgggattacaggtgtgagccacagcacctggccaaccaacacttctcagggcctctttcatctgtgctcttccaggatgctgcctcttactccctgggcacctcggcctggtcccagcaggtatgggcaggttgcttgaggctccagacatactcacctctacctcgaccacatcaaccccatcaccaagaggaggttcagggaagctgcattttgtggtcttgtcctcccagtccagggtggtagtgctgggctgttcccagcctcccacagcagagctggacgctgtggaaatggctggattcctctgtgttctttcccattatccctcagctctgagtcctcttgtgccatctgacatctgatgccttcccaaccactgccgagtttctgcctggagcagggcctcaaggccctggcacacagaagatgcgtatcagtattatcaaccaatagttgatgaattgtgtttttcaacgaatttgctagtgatctggtttactgccttagtaatatctagttcctaatatgcctatgccttttaatgtctgcacagtctgtgatgatgtcacttctctcaagcctgatgtgtcctctctctctttcttgctagtggtttatcaatttttaaaaccttttcttgtttatttgtttttgagacagaattttgctcttgttgcccaggctggagtgcaatggcgtgatcttggctcacagcaacctctacctcctgggttcaagtgattctcgtgcctcagcctcctgagtagctgggctgacaggcacccaccaccacacccagctaatttttatgtttttagtagagatggggtttcaccttgttgggtggccaggctggtctccaactcctgagctcaggtgatccacccgcctcagcctcccaaagtgctgggattacaggggtgagccaccacgcccagccccagcttagttttttaaaaagtttattttagccattctaataggtatgtagacatatctaatagtggttttccttgcgtttccttaatgtctgatgatgttaagcattttttccccaagtgcttagttgccatctatatagcatctttgatgaaatgtctgtttatatattttgcacactttaaaatattgggttgttttcttt

SEQ ID NO: 4268 - DNA, 984 bp, Homo sapiens
tacccaggctggtctggaactcctgagctcaggcaatccgcctgcctcggcctctcaaagtgctgagattacaggtgtgagccactgcgcccggcaccttaaatacacttttaaagttaaacttatggagggaaaaccctcatctattgacatagattgtatgtccttttttggtccctccatgaaggagcaccgttttctccatcatttcttcttcccttcacccgtcagagtgaccgaggctggggaccccagaagccccagagcaggcccgaatctgggacttccacggtcctgggggaggggtgcggggacactcacgtgtggcgcggatgtccggggtgtgaaggcagcgggcgcagctcggcggcgccggaggagccctctgcgcccaggaacaagacagggaagatgaagccggggctgaggcgcaggcgcgggcgcggcctggggtgtggcctggggcgtggcctgggcgcggcctggggcgtggcctggcccgaccacccgcccgctccgcccaggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgttta

SEQ ID NO: 4269 - DNA, 2026 bp, Homo sapiens
gagaaacgcgacgccttgggccgctctgccgaatgcaaccgcgcccccaggagacccggtgcccgccctcctaccattccacgcggctcgagcccgcgtgcgggcctctttcaggccgctcctagtggacgcagaggcgggccgaggacggtgagtgacgccgacggacaccctcggccaggcacagatccgccctccggctccaaccactcccgccgcgcggggcaggacgggcctcggccctgagctgggccctctgggaccaccgagagataggcctccgcgccgtccagagcggcccggaagtggccctgcacgggccagaggcgaccgtggtcgggacggaaatggctcccgtttgctgttctctcggtgaacgcgagccttatggcgatcagttctgtggcatcgttcctcctgctcgtttattctttcactcattcactcatgccctgccgcgccatcatttcttcccacattcatttattcgttcatcagtccccagccccgggtagtttcggagctcaccaggctgggctcgcctcccagcctccggagctgcccgcacaggcctcgcgccacctggccgcagcttcctcccctttatccactccgtatttgtttgtccagcctaggccttgggggttgtgggggagacacaagtacccgtgactggtcggacaagtgcccgttgttgggggcgtgggcgctgggactgacgcgggaggtggctctgatcatgtcgaggtgaggaggaggcgttgaggctcagaaagggcacgcagcgtggacgtgaggacgtcggggaggctggagcagtgaggccgacaggaaggaccttacggggctcacatgctatcccacgacgaggacggactcaggacggcagccctgatagatgcggctgggggctggcgggtcggggtcgcacaccacaggatggaggggcagcggtgcctggctccgccttaagaaacatgggcccttgggggacccggatttctgatacttcaatacacaaatatggatttttattgaaatcagatgtcgtttttttaaaatttaacttttgatttgaggtaattataaattcacatgcagtaacaagtaatgcataccctatgtacgctttacccaattcccctaaaggtggcatcttgaaaaactagaggccaggtgcggtggctcatgtctgtaatcccagcactttgggaggccaaggcgggtggatcccttgagctcaggagttaaagaccagcctgagcaacatggtgaaaccccatctgtactgaaaacacaaaaattaggcgggtgtggaggctggtgcctgtaatcccagctactcgggagtctcaggcaggagaatcgcttgtacccaggaggcggaggtcgcggtgagcccacatcacgccactgcactccaacctgggcaacagagcgagactctgtctcaaaaaaagagaagagaaagaaaaactagagtacaatatcacaactgagatgcagaatatttccatcacgaaggatccccgtgttgcccttacagagccgcatacccttccctcctacctctgctccccgttaacctctttttgtcaactagtaatctgttctcatttctaccattttgtcattttacgaatgttgcataggctgggcgaggtgtctcgcgcctgtaatactagcactttgggaggccgaggcgggtggaccatctgaggtcaagagttcaggaccggcccaccggccgggtgccgtggctcacgcctgtaatcccagcactttgggaggctgaggcgggcggatcacgaggtcaggagatcgagaccatcctggctaacacggtgaaaccccggctctaccaaaaatataaaaaaattagccgggcatggtggcaggcgcctgtagtcccagctacttgggaggctgaggcaggagaatggtatgaacccgggaggcagagcttgcagtgagccaggatagcgccactggactccagcctgggcgacagagcaagactcttctc

SEQ ID NO: 4270 - DNA, 2175 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtttgagcatggcagaaggaaacaccctgatatcagtggattatgaaatttttgggaaggtgcaaggggtgtttttccgtaagcatactcagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 4271 - DNA, 1956 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 4272 - DNA, 1804 bp, Homo sapiens
ttttgagacagagtcttgctctgttgcctaggctaaagtgcagtagtgcgatctcggctcactgcaacctccacttcctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 4273 - DNA, 698 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 4274 - DNA, 733 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcagctttgtttttgggaggctgaggaaggaggatcatttgagcctgggaggttaaggctgcaataagctgtgactgtgccaccatccttcagaaaaaaaaaagaaaaaggaaaagaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 4275 - DNA, 746 bp, Homo sapiens
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 4276 - DNA, 782 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggaaatgactgttgaaaacagaattgctgaaactcacagcaagagctgtgttccagttagctttgctaccagttatgcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 4277 - DNA, 627 bp, Homo sapiens
tccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 4278 - DNA, 1284 bp, Homo sapiens
ccaacgttggtgccagtagatattcaatgcattgtaagaatgagtttgtcttaaaaatttttttaaagcaaattctatgcgtcaggcactgttcaaagtgccggggatacagcgtggaacagttattaaattaacaagtaccctctgaaatagactctattaataccccaattttagaaataaacaaactgaagcccagagaagcaaagtaccctagtatcctgcccaaggtcacttgggtacaaggccaagaacaaccacagtcatgatattgacatctgcggagcttaccacgtgccaaacaccgtgcgaatccgcacagaatccgcacacccaccggttggggcagggacatctctgccactgatgcggagaggaaacggattcccgaggctcctgagagggatcctgggttccattcaccacacctcgctgctttttactgattcagttggaactggaagggaaaacaacggagctgatgagctccaaaaatgctccggggaccatctccctctcgcccgttcgcaggtctagtgacggagcccgcgcgcggcgccaccatgcggcagaaggcggtatcgcttttcttgtgctacctgctgctcttcacttgcagtggggtggaggcaggtaagaaaaagtgctcggagagctcggacagcggctccgggttctggaaggccctgaccttcatggccgtcggaggaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgccttttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaaaaaattgtc

SEQ ID NO: 4279 - DNA, 4649 bp, Homo sapiens
ccttatgtctatgtagatagaagaggatatttaagagataactacttttttttctgagacgaagtcttgctctgtcacctgggctggagtgcagtggcgcgatctcaactcattgcaaccgccgcctcccaggttcaagagattctcctgcctcagcctcctgaatagctgagattacaggcatgcgccaccatgcccggctaatttttgtgtttttagtagagactgggtttcaccatgttggccaggctggtctcgaattcctcacctcccgccaggtgatctgcccgcctcggcctcccaaagtgctgagattataggcgtgagccaccgtaccaggccagagataacttcttactggtttacctttcctgttaacattttagagcaagattacacattctctgaaggaaaatgctagttacttacaggatttaagtaatagttgtatctaacacctgatctgtatcaaaatgagtctcttttcttagagtcactagtacttttcaattctgatcactttcctatgttgtattcatgaaatgaacacaagctggggaaagacattatttgctaccaagtgacaatcttttcaatcctgcaaataatagagcataggactataccaagatttctcttctgttggaagttttgacttcaacttcatattccaaactgggctgcttacttgggtgacattacataggatgactttgcccctatagttaagtgattgcacctttaaacagaagttttcatatcatggacatatttttaaatccataagatgacagatctggaagaaagacacttataaagcttcataaagccactgattctttagctttgtggttttgctttataatctacatactaaccctttcagcttattaacattcttataatcagatatacattcttaccacatcatttcctcagagttctctgttttcatgtaaaaatccaattcaacacagtatttaaaagctgctagccattttttagacaagcatcttcctgtctttttatctgttttttaaaaataatcttgccttgagatataaatgatcccagaacttttctgatatctttgtatttttatcaaaagtgttactttttctaaaatcagctaaatttttgaagtctgatgtaactattttgaatttttagaaaaccatgattatttaccaagaattggagtttctcttctgtaagcaataaagaaaaataaagttcagccacatcttcactagagaaaataaaaatgaaaacaaggaaaaacaaagttttacatgttgtttgatgcaaagagtggagaacttggataggaatggatattcactcctgaattctaaccataggctgaaatctacctccaaagagataggctgagtttgcttttggatccaagtgcaccagccatgactgtgttgaccttattcacgtggcttattacagaccagtaatggaccatttttttcagttgctggcctggcagttttgttttggagacaattttttatttctgtgcattagccctgggcacacacctggctaagtccagagttctgtgtctttttaaccttttgctggatttctctgcattttctacagaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcat

SEQ ID NO: 4280 - DNA, 4916 bp, Homo sapiens
ccttatgtctatgtagatagaagaggatatttaagagataactacttttttttctgagacgaagtcttgctctgtcacctgggctggagtgcagtggcgcgatctcaactcattgcaaccgccgcctcccaggttcaagagattctcctgcctcagcctcctgaatagctgagattacaggcatgcgccaccatgcccggctaatttttgtgtttttagtagagactgggtttcaccatgttggccaggctggtctcgaattcctcacctcccgccaggtgatctgcccgcctcggcctcccaaagtgctgagattataggcgtgagccaccgtaccaggccagagataacttcttactggtttacctttcctgttaacattttagagcaagattacacattctctgaaggaaaatgctagttacttacaggatttaagtaatagttgtatctaacacctgatctgtatcaaaatgagtctcttttcttagagtcactagtacttttcaattctgatcactttcctatgttgtattcatgaaatgaacacaagctggggaaagacattatttgctaccaagtgacaatcttttcaatcctgcaaataatagagcataggactataccaagatttctcttctgttggaagttttgacttcaacttcatattccaaactgggctgcttacttgggtgacattacataggatgactttgcccctatagttaagtgattgcacctttaaacagaagttttcatatcatggacatatttttaaatccataagatgacagatctggaagaaagacacttataaagcttcataaagccactgattctttagctttgtggttttgctttataatctacatactaaccctttcagcttattaacattcttataatcagatatacattcttaccacatcatttcctcagagttctctgttttcatgtaaaaatccaattcaacacagtatttaaaagctgctagccattttttagacaagcatcttcctgtctttttatctgttttttaaaaataatcttgccttgagatataaatgatcccagaacttttctgatatctttgtatttttatcaaaagtgttactttttctaaaatcagctaaatttttgaagtctgatgtaactattttgaatttttagaaaaccatgattatttaccaagaattggagtttctcttctgtaagcaataaagaaaaataaagttcagccacatcttcactagagaaaataaaaatgaaaacaaggaaaaacaaagttttacatgttgtttgatgcaaagagtggagaacttggataggaatggatattcactcctgaattctaaccataggctgaaatctacctccaaagagataggctgagtttgcttttggatccaagtgcaccagccatgactgtgttgaccttattcacgtggcttattacagaccagtaatggaccatttttttcagttgctggcctggcagttttgttttggagacaattttttatttctgtgcattagccctgggcacacacctggctaagtccagagttctgtgtctttttaaccttttgctggatttctctgcattttctacagaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttaggtaggtccctactgtctgggggaaaaagccttgtggagctggcaccttgaaacgtaactgttttgtcttgtagaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcat

SEQ ID NO: 4281 - DNA, 3627 bp, Homo sapiens
tttttgagacggagtcttgctctgtcgcccaggctagagtgcagtgatatgatctcggctcactgcaacctctgcctcctgggttcaagtgattcttttgcctcagcctctcgagtagctgggattacaggcacgcaccaccatgctcagctaatttttgtatttttagtagagatggggttttgccattttggccaggctggtctcaaattcctgacctcaggtgatctggtctcaaactccgacctcaggtgatctgcctgcctaggcctcccaaagtgctggaattacaggtgtgagccaccacgcccatccagacactagtatttctaattgtttctttttcattatcttggagctttttacactctagtttcaaaatggttgaaaatatgcctttcttttataaagtgggacaagggcagttgtgaaaggggggagatgggaaaaaagccttgatggccagaggtacattcttatgaagatcaatttttggaaaaatctatatgtggaactgagtatctggaatttgattctctcttgactgacctttctcagtgtactccttgacagtgttcctgtttccccaggggcgtgcttgtcccaactgaaggccactggtataatggactctttgtagtaattggctacacctttctaaaacaagtggtcccgtttaattagctaccttagggtgaaatgaaatgtagggaacgagtctaagtctttcttgatggtagctctctcctcttatttctgcatttattaaggtataagaactctttgctctcatgtgacttaaaatcagcagctggaaatattcttgttgcaagataagtgattaagcctcaggaaaataccttgctttctaaggtctgtctggcctaaaatacccttgtagctgctgttgggttccaaacaaatggatgaggaaaaagggttaggccagattagcatgaggcagttttggggaaaagacaaacccttcttttgtatgtatgtctgtgtacccaggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcat

SEQ ID NO: 4282 - DNA, 4389 bp, Homo sapiens
ttcagtagaccgtccacaaatgttagccattaccctcaccactgagacccaccatttccataacaggcactgttccaggttctggggacatagggggatgaagaaagatgggtctctgccctcttggaggttatggttttatgggaagattctttttgtaatgatttcaagttaattaacttatttattagcaaatggcaaagctcccccacccctatctgcccctcttcttgcctggattgatttctcttctctctcttctaaaatccttagtaatgataaaagggcagggttctgggatgcctggaggggtaggaaataatcccagctccttctttccccttctagtgcccatgactaggctgttaccgattgactcctagcttgttattgttgctgtgtgctggtctttggggctctgtttccctggtggggtgtctatgctctttaatgcatcccaggaggatcctaagatgtgaggccatgaggaccaacgccagctccttgtctactacactctgaggctcaggcagatataagagggtcttccaatcgaatgtgatatttggcttccttagatgcttctgccttagatcagcccagagggtggctgtggtggaaggcttagcattattatttcatccccaatagtgagagggagctggggagggacaggggagggagatagaggatggataaagaggtttcccttggattagactctgtctgggagagaatcaaactaggctcgtatttcaccaatgctggacctaaaagaagaggaagtgggggaaggagggaggaagagctatctttagtacccagcccctcttccccattagtcaatgcctaagaataataatcatagccagtattatgggaggtgcttatttttgggccaagctgagtattttaaatgcatcttttcaattaattcttataataaccctttgagaaatgaagtacattatcattttattgatgagaagatgaggaacagattcggcatgtaacaggttcaaggctccacctttacaaagtggcattactgagactcaagctgagagctctcagatgccatagtgaatgctctgcactgcttacttttgcccacccacctccggcgccacccctggcagcagcactgtattccaggaatagccagaccccgccctaagagcgaatatgtcctttcgtcacctaccaagtatgggtgctttccaaaacacacttccaagtcctctccagcttttcattttcttggggcctaatttttcctttttaaattttctccagtcagagagggcacctaattcctttatttccctttactcttgtgtactggctggttgtcctccattctctttgtttacatccatcgctgcctcctttcttcccagtctttccggctctgggtttgcatccctgccctcagtgtctcccagtttccttgctttcttttatttccctcctgattgctgcctccccagttcttaccagctctctgtcccagtcctttcctgtcaaagatggcagactcctccaatgccaccgctcccctacccatctgcccggagtcttcccttctctctccctccctgctggctcttttggccatcccccttccctgcataatctttattgcttgcatgactgctcaggttctttatcccatcttcccctcaaaggcattcgcagctccgctgttattcttgtattagcattgaacccattaaagctaatttgtttgccctaatctccatttatttttccctagttgatattagatttccctttctattgctccagcatgattttctctttgtcttcctaatggtctacccccctctctcttcctctattaatctggttggcttcactgtgtggtttcaaggcctttctctgcctcccccagcccttagattaaccctgtcacctccctcccaagaagggcttcagtgtgtggatttttagggatggagctgcttcaaatgtcaatagacctctaagctccttaagaaaagtactacttgacatgaggccctgccttttcctggagccaagctggagaccttgggagcacaggggccagagagcttgaggcaagtgagacacacatgggctgctctgagcctgaaggtcaccaagtccaagggttccctgggtagggttgcctttggtgctgtctcagagatttctggaggtctcttcacgctgtcttagatcctataaattatatcagcaatataaggtatataaagtaacagcagatgagccactttctccctctgagattgggcaccatttcccaagcaggggactcacttcctttccttcctgcaggagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4283 - DNA, 2764 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgatggagttttgctcttgttgcccaagctggagtgcaatggtgcgatcttcgcttactgcaacctctgcttcctgggttcaagtgattcccctgcctcagcctcccgagtagcagggattacagatggagcctcgctctgtcacccaggctggagtgcagtggcacaatctcgggtcactgcaacctccgccccccagcttcaagcgattctcctgtctcagcctcccgagtagctaggattacaggtgcacgccaccaggcctggctaatttttatatttttagtagagatgggattttgccttgttggccaggctggtctcaaactcctgacctcaggtgacccatccaccttggcctcccaaagtgctgggactacaggtgtgagccaccatgcctggtcccccacttgttgattttgcagaaaagatagctgtgttacaacctgtcctaaggtcaggtatgaatacttgtgcttctttcttggctccccaagccagagggcattcctatgcccaggtgagagagcacggagtgttactttggcagcacagtcagttaccagaggtaggaaaagcaaaggccaggcaggacatgaggggcccttgcactggctggttctccctgccttcaccaccctccaggtgaatgactgggtgaataatgattgactgaggaggtaatgaataatttatggacactgctggacctcagtctcctcatctgaaagatgagtggttggagaagtttaatggttttcaaatgctttttttttcagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattgctgatgcagattgcctgcccagctgcgagtgctggcacgggaccagcagcccagacggtcactggaagtggttgggctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgtttcatgaggcttccctgtcc

SEQ ID NO: 4284 - DNA, 2716 bp, Homo sapiens
ggaaggggtggagctagaactggacacctcgggggtttcctgctttatggcgaagggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgcgggagccgcctaggaccggaggcgcgacccctcggcccaccttgaggcccggcctaggaccggaggcgcgacccctgggcccaccttgaggcccggcctaggactggaggcgcgacccctcggcccaccttacgggagccgcctagggccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgatggagttttgctcttgttgcccaagctggagtgcaatggtgcgatcttcgcttactgcaacctctgcttcctgggttcaagtgattcccctgcctcagcctcccgagtagcagggattacagatggagcctcgctctgtcacccaggctggagtgcagtggcacaatctcgggtcactgcaacctccgccccccagcttcaagcgattctcctgtctcagcctcccgagtagctaggattacaggtgcacgccaccaggcctggctaatttttatatttttagtagagatgggattttgccttgttggccaggctggtctcaaactcctgacctcaggtgacccatccaccttggcctcccaaagtgctgggactacaggtgtgagccaccatgcctggtcccccacttgttgattttgcagaaaagatagctgtgttacaacctgtcctaaggtcaggtatgaatacttgtgcttctttcttggctccccaagccagagggcattcctatgcccaggtgagagagcacggagtgttactttggcagcacagtcagttaccagaggtaggaaaagcaaaggccaggcaggacatgaggggcccttgcactggctggttctccctgccttcaccaccctccaggtgaatgactgggtgaataatgattgactgaggaggtaatgaataatttatggacactgctggacctcagtctcctcatctgaaagatgagtggttggagaagtttaatggttttcaaatgctttttttttcagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattgctgatgcagattgcctgcccagctgcgagtgctggcacgggaccagcagcccagacggtcactggaagtggttgggctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgtttcatgaggcttccctgtcc

SEQ ID NO: 4285 - DNA, 3305 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgcgggagccgcctaggaccggaggcgcgacccctcggcccaccttgaggcccggcctaggaccggaggcgcgacccctgggcccaccttgaggcccggcctaggactggaggcgcgacccctcggcccaccttacgggagccgcctagggccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacgggacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4286 - DNA, 3454 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgcgggagccgcctaggaccggaggcgcgacccctcggcccaccttgaggcccggcctaggaccggaggcgcgacccctgggcccaccttgaggcccggcctaggactggaggcgcgacccctcggcccaccttacgggagccgcctagggccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctggtacaaagcactgggaatacaaccttgaacaagacaagaatcctggccttcaaggaacttcgaaccttttgggggatatgataagacacattaggaatcaccatgttaatggttatctttcttgaaggatataagtccagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4287 - DNA, 2110 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgatggagttttgctcttgttgcccaagctggagtgcaatggtgcgatcttcgcttactgcaacctctgcttcctgggttcaagtgattcccctgcctcagcctcccgagtagcagggattacagtcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattgctgatgcagattgcctgcccagctgcgagtgctggcacgggaccagcagcccagacggtcactggaagtggttgggctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgtttcatgaggcttccctgtcc

SEQ ID NO: 4288 - DNA, 3248 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctggtacaaagcactgggaatacaaccttgaacaagacaagaatcctggccttcaaggaacttcgaaccttttgggggatatgataagacacattaggaatcaccatgttaatggttatctttcttgaaggatataagtccaggtgcttggggagacccacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4289 - DNA, 3553 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctggtacaaagcactgggaatacaaccttgaacaagacaagaatcctggccttcaaggaacttcgaaccttttgggggatatgataagacacattaggaatcaccatgttaatggttatctttcttgaaggatataagtccaggtgcttggggagacccgtaagtggttagagggaagctgcaaggaagagtatctaggaggtaactaggtgaagaattttcttcagggggaaagaaatccatgcataaagtcttggtgccttcaagaaattgaaagacatttagtgtggctgtaggacaggcaggaaagagaatttggaaagagcctgctggctgcagatggagatggcccctatggtttgaagttttaagctgagtctctgcaatggaaagacctttgtctttcctgtgtccggtgtgggggagtggactcttctgggtgagtcaccaccaaatgcccagagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4290 - DNA, 3215 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgatggagttttgctcttgttgcccaagctggagtgcaatggtgcgatcttcgcttactgcaacctctgcttcctgggttcaagtgattcccctgcctcagcctcccgagtagcagggattacagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4291 - DNA, 3092 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4292 - DNA, 3055 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgatggagttttgctcttgttgcccaagctggagtgcaatggtgcgatcttcgcttactgcaacctctgcttcctgggttcaagtgattcccctgcctcagcctcccgagtagcagggattacaggagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4293 - DNA, 4306 bp, Homo sapiens
ttcagtagaccgtccacaaatgttagccattaccctcaccactgagacccaccatttccataacaggcactgttccaggttctggggacatagggggatgaagaaagatgggtctctgccctcttggaggttatggttttatgggaagattctttttgtaatgatttcaagttaattaacttatttattagcaaatggcaaagctcccccacccctatctgcccctcttcttgcctggattgatttctcttctctctcttctaaaatccttagtaatgataaaagggcagggttctgggatgcctggaggggtaggaaataatcccagctccttctttccccttctagtgcccatgactaggctgttaccgattgactcctagcttgttattgttgctgtgtgctggtctttggggctctgtttccctggtggggtgtctatgctctttaatgcatcccaggaggatcctaagatgtgaggccatgaggaccaacgccagctccttgtctactacactctgaggctcaggcagatataagagggtcttccaatcgaatgtgatatttggcttccttagatgcttctgccttagatcagcccagagggtggctgtggtggaaggcttagcattattatttcatccccaatagtgagagggagctggggagggacaggggagggagatagaggatggataaagaggtttcccttggattagactctgtctgggagagaatcaaactaggctcgtatttcaccaatgctggacctaaaagaagaggaagtgggggaaggagggaggaagagctatctttagtacccagcccctcttccccattagtcaatgcctaagaataataatcatagccagtattatgggaggtgcttatttttgggccaagctgagtattttaaatgcatcttttcaattaattcttataataaccctttgagaaatgaagtacattatcattttattgatgagaagatgaggaacagattcggcatgtaacaggttcaaggctccacctttacaaagtggcattactgagactcaagctgagagctctcagatgccatagtgaatgctctgcactgcttacttttgcccacccacctccggcgccacccctggcagcagcactgtattccaggaatagccagaccccgccctaagagcgaatatgtcctttcgtcacctaccaagtatgggtgctttccaaaacacacttccaagtcctctccagcttttcattttcttggggcctaatttttcctttttaaattttctccagtcagagagggcacctaattcctttatttccctttactcttgtgtactggctggttgtcctccattctctttgtttacatccatcgctgcctcctttcttcccagtctttccggctctgggtttgcatccctgccctcagtgtctcccagtttccttgctttcttttatttccctcctgattgctgcctccccagttcttaccagctctctgtcccagtcctttcctgtcaaagatggcagactcctccaatgccaccgctcccctacccatctgcccggagtcttcccttctctctccctccctgctggctcttttggccatcccccttccctgcataatctttattgcttgcatgactgctcaggttctttatcccatcttcccctcaaaggcattcgcagctccgctgttattcttgtattagcattgaacccattaaagctaatttgtttgccctaatctccatttatttttccctagttgatattagatttccctttctattgctccagcatgattttctctttgtcttcctaatggtctacccccctctctcttcctctattaatctggttggcttcactgtgtggtttcaaggcctttctctgcctcccccagcccttagattaaccctgtcacctccctcccaagaagggcttcagtgtgtggatttttagggatggagctgcttcaaatgtcaatagacctctaagctccttaagaaaagtactacttgacatgaggccctgccttttcctggagccaagctggagaccttgggagcacaggggccagagagcttgaggcaagtgagacacacatgggctgctctgagcctgaaggtcaccaagtccaagggttccctgggtagggttgcctttggtgctgtctcagagatttctggaggtctcttcacgctgtcttagatcctataaattatatcagcaatataaggtatataaagtaacagcagatgagccactttctccctctgagattgggcaccatttcccaagcaggggactcacttcctttccttcctgcaggagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgta

SEQ ID NO: 4294 - DNA, 4337 bp, Homo sapiens
ttcagtagaccgtccacaaatgttagccattaccctcaccactgagacccaccatttccataacaggcactgttccaggttctggggacatagggggatgaagaaagatgggtctctgccctcttggaggttatggttttatgggaagattctttttgtaatgatttcaagttaattaacttatttattagcaaatggcaaagctcccccacccctatctgcccctcttcttgcctggattgatttctcttctctctcttctaaaatccttagtaatgataaaagggcagggttctgggatgcctggaggggtaggaaataatcccagctccttctttccccttctagtgcccatgactaggctgttaccgattgactcctagcttgttattgttgctgtgtgctggtctttggggctctgtttccctggtggggtgtctatgctctttaatgcatcccaggaggatcctaagatgtgaggccatgaggaccaacgccagctccttgtctactacactctgaggctcaggcagatataagagggtcttccaatcgaatgtgatatttggcttccttagatgcttctgccttagatcagcccagagggtggctgtggtggaaggcttagcattattatttcatccccaatagtgagagggagctggggagggacaggggagggagatagaggatggataaagaggtttcccttggattagactctgtctgggagagaatcaaactaggctcgtatttcaccaatgctggacctaaaagaagaggaagtgggggaaggagggaggaagagctatctttagtacccagcccctcttccccattagtcaatgcctaagaataataatcatagccagtattatgggaggtgcttatttttgggccaagctgagtattttaaatgcatcttttcaattaattcttataataaccctttgagaaatgaagtacattatcattttattgatgagaagatgaggaacagattcggcatgtaacaggttcaaggctccacctttacaaagtggcattactgagactcaagctgagagctctcagatgccatagtgaatgctctgcactgcttacttttgcccacccacctccggcgccacccctggcagcagcactgtattccaggaatagccagaccccgccctaagagcgaatatgtcctttcgtcacctaccaagtatgggtgctttccaaaacacacttccaagtcctctccagcttttcattttcttggggcctaatttttcctttttaaattttctccagtcagagagggcacctaattcctttatttccctttactcttgtgtactggctggttgtcctccattctctttgtttacatccatcgctgcctcctttcttcccagtctttccggctctgggtttgcatccctgccctcagtgtctcccagtttccttgctttcttttatttccctcctgattgctgcctccccagttcttaccagctctctgtcccagtcctttcctgtcaaagatggcagactcctccaatgccaccgctcccctacccatctgcccggagtcttcccttctctctccctccctgctggctcttttggccatcccccttccctgcataatctttattgcttgcatgactgctcaggttctttatcccatcttcccctcaaaggcattcgcagctccgctgttattcttgtattagcattgaacccattaaagctaatttgtttgccctaatctccatttatttttccctagttgatattagatttccctttctattgctccagcatgattttctctttgtcttcctaatggtctacccccctctctcttcctctattaatctggttggcttcactgtgtggtttcaaggcctttctctgcctcccccagcccttagattaaccctgtcacctccctcccaagaagggcttcagtgtgtggatttttagggatggagctgcttcaaatgtcaatagacctctaagctccttaagaaaagtactacttgacatgaggccctgccttttcctggagccaagctggagaccttgggagcacaggggccagagagcttgaggcaagtgagacacacatgggctgctctgagcctgaaggtcaccaagtccaagggttccctgggtagggttgcctttggtgctgtctcagagatttctggaggtctcttcacgctgtcttagatcctataaattatatcagcaatataaggtatataaagtaacagcagatgagccactttctccctctgagattgggcaccatttcccaagcaggggactcacttcctttccttcctgcaggagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactgtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4295 - DNA, 3232 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctggtacaaagcactgggaatacaaccttgaacaagacaagaatcctggccttcaaggaacttcgaaccttttgggggatatgataagacacattaggaatcaccatgttaatggttatctttcttgaaggatataagtccaggtgcttggggagacccgtaagtggttagagggaagctgcaaggaagagtatctaggaggtaactaggtgaagaattttcttcagggggaaagaaatccatgcataaagtcttggtgccttcaagaaattgaaagacatttagtgtggctgtaggacaggcaggaaagagaatttggaaagagcctgctggctgcagatggagatggcccctatggtttgaagttttaagctgagtctctgcaatggaaagacctttgtctttcctgtgtccggtgtgggggagtggactcttctgggtgagtcaccaccaaatgcccagagacacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgctgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4296 - DNA, 2734 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgatggagttttgctcttgttgcccaagctggagtgcaatggtgcgatcttcgcttactgcaacctctgcttcctgggttcaagtgattcccctgcctcagcctcccgagtagcagggattacagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 4297 - DNA, 1739 bp, Homo sapiens
ggaaggggtggagctagaactggacacctcgggggtttcctgctttatggcgaagggtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacaggagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccaccttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccaggccagggccccacaccttccgcctgacagccagccaagctcttcagtcccccgccctccacctgccagggaggctccgggcgttgtacctgccaccacggggtaggtctgatggagttttgctcttgttgcccaagctggagtgcaatggtgcgatcttcgcttactgcaacctctgcttcctgggttcaagtgattcccctgcctcagcctcccgagtagcagggattacaggtgcgtgctaccatgccaggctaattttttgtatctttagtagagacaggagtttcaccatgttggccaggctagtcttaaactcctgacctcatgatctgcctggcttgacctcccaaagtgttgggattacaggcatgagccgttgcacctggccagggtgtgtcttattgaaattgaacaaaatacctaatttctagagcgtataagagaagtttaaaatgctttatggatgtgttgttttgacagcaaaatatctactcagaatcctatagctatttcaaaatccaagtaacttagaaaaaaaggaaaaagaaaacctatatagtcaaatcttttggtgattttgtattcaatgactgaaacttcccagtgattattgggctttttagctggaattgaacttgaatcggggcagagcagcacaatgcttcagaacttcagcgactctgagccctggttctgcaatgacctgccaagtagctttagtctacttgactgctctgaaccttaattttctcacctgtatgggaatcatagactctactttatgaggctgacgtaagcattacatgaaattttgtatacttatacataatgtgcttagcaccgaatacttggtgacagcagatgcccaatgagagttatcacagatattatttcagaatcgtgaagagtcagaagccaccaaattcttgatttctgtcaataaactgatattcatattctg

SEQ ID NO: 4298 - DNA, 2056 bp, Homo sapiens
cactggctgaaattaacctgacaggaacgcgtcctgtgtgattgtgtttctctcattccagacgtgcgtgtgtgtgcgtgtgtgtgtgtctctactttgggttaatgtgggaatgctttcctatatcaataagtcacaagtcgatctgtgaaaagattgtgcatacaaaatggagatgaagatcacaggggctttaataataaaataaacataaacaacactcgaatctctttataaatcccagagcacaatgtgcgttttcttacttccttttcatggaccccaaataaagactttgacagccagatatccaagatccggatcagccagcttcctaaaattctcctctttttttttaaggggtagaaaactgggggtatcccttggtggttaggggttgcttagagactgtggtagagatttggtgttaacaaaaatgtattttgaaagcaggatttcaattttcttatattgaatggcaaaggttccatgcacctggctatcttcatttctgaaatgaatgctttcattttattctctccagctaccttctccctttctttcctttccacccccattgcctcctttcagtgtctttctttttctccttattctttcactcctttctctctcacagcaaaatgttctggaggatgtgaatgattaaactgtttactccaaggtttaggtatgaaaaggcaagtcactgtaagtaaagtttcacctttatacccaactccatcaataattacagaacaaggatgactattagtaaatctttcttacaattggctcttacaaaaatgatttcattttttctgggcataccaagtttgacagattttacttttcacaaaaattatttacacagcagaggaacctgctccaaaatgaaggaagcatataaagggccgttgagtgtatccataggaaaatgaatacctataaaatgcatctcaataaattagagatttgaggccataaatagaacgttttgacgtattatattagtagatgccctctaatttaaaccaaagtgtcccttaataattaaaattccatgagattgattttttatttggtttccttcacttcctttgtcttcttcaacaaaattaggcagagtccttttgggggtagactgataaaattaattaactttccttccacccccaaaaagttccaaataaatgcttccaatagacatcaaaaaagtgtcaattagaaataactacttcttatcaatcagtggggcaattaaagtgacaaagcttaaaaagatacttatcttaaaactaattcacaaggtagctaaattatctcctaattaacttgcattgtggagggtgggggggaaccatcttgaaacaaagatgaattgatgaaccccaatacctctttatgttcctcaaagttgcttccatcccctgaaaccttattttcaacccaggcaggaaacctgggaagaaaacagatcctttccaaatgcatttattccactttcctcaattctaaaaccaagagttaggaatggggctttagatctcacatcagggaagttagagacatcgtcctctgcctggggaaaagggggaacctgctaaaacccgagagataatgggcttgtaaaaaccagaggggtccgcttatgagtttagctccggttatagacaacagtgtcaggtaagctgatcagaaagacagacggcctctccctcaggtttgccgagggagggttcagaaaagaaacagggagcgccttcagcagtctatgcggttataggccattttcttgttttattagcgtttaaattaaactatgagaagaaagtctcatcttccctccctcgccactttgtctatttgttttggaaagagggtagaagaagcccctctgtcttcccgaaaagaagaaaggggaaaaaaattacctggtaggtccaggggcagagggctccctcccaaaacccaagcgcgatttgcatccaagctagtgggaaagcgcgcatctcatcatctgggactgttcctgattaaaactacagtaaaaataaat

SEQ ID NO: 4299 - DNA, 4344 bp, Homo sapiens
cccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggtaagcgtggggcccccacacagcctcccccttcccctcagggtgcaaggatccctccagtaggggtggccctgggtgccagattaagtaagaacgttgtcagttgcatgccacgcagtgggtactgtgggaacacctcatgacatgacagccatccctcagtatctgggggttggtccctcagtatctaggggttggtttcaggaccccccttggatagcaaagtctgcagatgctccagtcccggattaaattggtgccgtatattgtagacacatcttcttgtatgctttagatggtctctaggttagttataatacctgatagaatgtaaatgctagatatagatataacatagttatgttttttatactactttttatcattgtgttgttttttattttttttctgagtattttcgatccttggctggttgaatctgcaaatgtggaacccgtagataggaggaccaactgtattggctcactgcaacctctgcctcccggttcaagcaactctcctgcctcagcctcccaagtagctgggattacaggcacgagccaccacgcctggccaattttttgtatctttagtggagacggggtttcaccatgttggccgggctatcctccagcctcagcctcctgaggcgtgactacaggtgcacgtcactatgcccagacccacagagcagttctgaccagaaccatcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcgggtggatcacgaggtcaggagatggagaccatcctggctagcacggtgaaaccccgtctctactgaagatacagaaattggctgggcgtggtggtggtacctgtcatcccagctactcgggaggctgaggcgggagaatcgcttgaacccgggaggcagaggttgcagtgagctgagatcacgccaccgcactccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaa

SEQ ID NO: 4300 - DNA, 4447 bp, Homo sapiens
cccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggtaagcgtggggcccccacacagcctcccccttcccctcagggtgcaaggatccctccagtaggggtggccctgggtgccagattaagtaagaacgttgtcagttgcatgccacgcagtgggtactgtgggaacacctcatgacatgacagccatccctcagtatctgggggttggtccctcagtatctaggggttggtttcaggaccccccttggatagcaaagtctgcagatgctccagtcccggattaaattggtgccgtatattgtagacacatcttcttgtatgctttagatggtctctaggttagttataatacctgatagaatgtaaatgctagatatagatataacatagttatgttttttatactactttttatcattgtgttgttttttattttttttctgagtattttcgatccttggctggttgaatctgcaaatgtggaacccgtagataggaggaccaactgtattggctcactgcaacctctgcctcccggttcaagcaactctcctgcctcagcctcccaagtagctgggattacaggcacgagccaccacgcctggccaattttttgtatctttagtggagacggggtttcaccatgttggccgggctatcctccagcctcagcctcctgaggcgtgactacaggtgcacgtcactatgcccagacccacagagcagttctgaccagaaccatcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcgggtggatcacgaggtcaggagatggagaccatcctggctagcacggtgaaaccccgtctctactgaagatacagaaattggctgggcgtggtggtggtacctgtcatcccagctactcgggaggctgaggcgggagaatcgcttgaacccgggaggcagaggttgcagtgagctgagatcacgccaccgcactccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggagcctgtccagggccaggcgctgcactggctcaggcctgcacggtggtggagaagacgtgcgtggtgaacacgacgccctccccgccgatctccgtttccaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaa

SEQ ID NO: 4301 - DNA, 1830 bp, Homo sapiens
tgttgttcccatgctctggattattgaaatacattgtaatttacctgcttaaaggaaagactaaatattaagaagaaaataaaaatatccctagtcccagtgataaagttgttcctaattttaggccattatgtaatgctgcagtaaatatcctgatccctaaaatcccaattttgaaaaattagagtatacatatattcagtataaatcccaaattacagtgtacatatatagtatatacagtgctgctcctaatgatggaaaattgttatgtacatgtagaatgtgcattctttgcctgtatctatagacgtactgtaatttacccacattgggatttttctgggttttctttcaacacagctaactttctcatgtcattgaggattattaaaagatgcagttttttttttttatggccatttagcattacataattttagcctatattcttgaacatgaggttgttcataattgttatattttatgtgccacagtgaaaatcctggtacataaatcttggtgtgctcacatgtttcctaaggtgcagttcctataattggaacaactggctcaaaggttggaagggttttccgggcgtgggtatcttgtctctgggggcatcggttctcctactgcctccagggggtgtctgccctccaccctgctgcctcctgtccggccactgcccagggtttctgtctttctgctcagtctttttcagtttggccaataacggtaccttgttgttttcacttctttgattcttagcggggctgaacattttttcgtaccctctggccatttgtatttcatagaggctgcttgtatgtattaaatgcatttcttttctgtaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaa

SEQ ID NO: 4302 - DNA, 5640 bp, Homo sapiens
tgcagtcccaggggagggagtcagagctagaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggtttgcagatttcttttgaaattcctttttcccccctccctctgcctcagcaaaagaaaagaatccatataacaggttcatgttcaattgcttggcttttcagcacttattctgaagactttataatatttttaaacttgaccttggaacacagagggctttgtgggtgaggtgtatttatatttacttaagggtgcacattttaaaaatcttattctgtgtttgtacaaagacgcaaattttcatagtgcctagaaatagcacagatctattctactcaagattatttgtattttttcagggtattctacctagagcctgtggttaatcgcctccctgctccccctaccttttattccctaccccctcagggaatttggatacatgtgaggaatagtcctttgtttttcttatgaacctagaaaattacagatcataaaatctggatattaaagtagtttccaaaagcatctcatgggaaatcaaagtgctcggcatttccgagctggagaataaaatcaagaatccttaagagagaaaagaaaatggagatggaaatatgaattttaactgggaaaaataattggaaagctaaccttttcaaatactctaattatgaaagttggaaaaggttgtgatgctcaggattatcctgtaatgtgtgaagatacataaattagcacctaatttataggcaaattttggtaaaacacaaaaaattatggtatgtctaagttcatgaaaagtatgtaaatgcagtgggcctagaaacctggccacactgaaatacagtttaatgtggaaacttttctaaatacatattgtagcatctttggacatcaacgtgtggcctgaaatttttattattgttccctcttctcctccattaaaaaaaaaatctccttgtggtatttagtcatttaccattaacacatattatggcttaaaaagggccatcccttccttttctgagctggagttcttcacgctcacctttgatgcatggccttagctgtttactttgccttgttttgttcatgaacattgggtttagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggaatgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 4303 - DNA, 4383 bp, Homo sapiens
tgcagtcccaggggagggagtcagagctagaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggaatgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 4304 - DNA, 2295 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4305 - DNA, 1895 bp, Homo sapiens
gattcgctggcgcgacgggggcggggcctgggtgcgggtgccgcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4306 - DNA, 1977 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacgagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4307 - DNA, 1915 bp, Homo sapiens
gattcgctggcgcgacgggggcggggcctgggtgcgggtgccgcgtggcggccgcagcgctgaggggtgggtacgacccgcgcacgagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4308 - DNA, 1899 bp, Homo sapiens
gattcgctggcgcgacgggggcggggcctgggtgcgggtgccgcgtggcggccgcagcgctgaggggtggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4309 - DNA, 2187 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaaagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4310 - DNA, 1964 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4311 - DNA, 2854 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaagtctacagattcaaatgttagtctcatgcaacccctccccacccctgccagaaacagaataatgtttgaccaaacactcaggcaccctgtagcccagtcaagtggacacatacaatcacccattccaggaggcccacaggattggaggagctgctgagggttgggttacaagggccaggggtgctctggttccttcaaccaacacatagttactgagtatggagacagcaagatgaggcccccttccctccagaggcagtgcacactgtgtgaggggagctgggctgggtagcagcagggtgtcagggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgct

SEQ ID NO: 4312 - DNA, 2145 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccacctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4313 - DNA, 1887 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4314 - DNA, 2446 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaagtctacagattcaaatgttagtctcatgcaacccctccccacccctgccagaaacagaataatgtttgaccaaacactcaggcaccctgtagcccagtcaagtggacacatacaatcacccattccaggaggcccacaggattggaggagctgctgagggttgggttacaagggccaggggtgctctggttccttcaaccaacacatagttactgagtatggagacagcaagatgaggcccccttccctccagaggcagtgcacactgtgtgaggggagctgggctgggtagcagcagggtgtcagggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgct

SEQ ID NO: 4315 - DNA, 1824 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgcctgtgtgggagggtggttactgtgggtggaatagtggaggccttcaactgattagacaaggcccgcccacatcttggagggcatctgccttactgattaaaatgtcaatgtaatcta

SEQ ID NO: 4316 - DNA, 1952 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4317 - DNA, 2131 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4318 - DNA, 3061 bp, Homo sapiens
cttcagatgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctgaaccctgtgaaccccaggcaatgacagcaggatcctgaagcccatgcaggctctgaaccacgcggccatccagaaggggctgcaggcacctgccactactgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggctcaccggggtggctttgcgggcgtccagggcaccttctgcatgccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgtccccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4319 - DNA, 1960 bp, Homo sapiens
aaggacaagtgaaaagccccagaatggcccctgcaaacagtaacagtaactaacagtcaaatgtctctgccccaggcaggttagggacgagacagaatgagggtggggagcggggctcggggagcagaggccacggtctccatgctctgctcctctggccgcagcagaaccctgtgaaccccaggcaatgacagcaggatcctgaagcccatgcaggctctgaaccacgcggccatccagaaggggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4320 - DNA, 2511 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaagtctacagattcaaatgttagtctcatgcaacccctccccacccctgccagaaacagaataatgtttgaccaaacactcaggcaccctgtagcccagtcaagtggacacatacaatcacccattccaggaggcccacaggattggaggagctgctgagggttgggttacaagggccaggggtgctctggttccttcaaccaacacatagttactgagtatggagacagcaagatgaggcccccttccctccagaggcagtgcacactgtgtgaggggagctgggctgggtagcagcagggtgtcagggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgct

SEQ ID NO: 4321 - DNA, 2202 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4322 - DNA, 2484 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaaggtagcaccgcaggcccagtggggtgtggagaggggctgtctagagcccgggccctcagtacttcagttttcatctgcaaaagggttgcagcgtcccggcccactgggagagctcgggcactgcttggtggggtgagtgcatctaggcactgcgtccatggccagacggacacgctggtttctcttccagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4323 - DNA, 2038 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4324 - DNA, 1951 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacggtgggcccccgcgctgcccgcttccctggtctccagtccttgcatggcagaggcctctctcacacacatctgctcattcacgcactcagcagatacgtattgagctccagcccagtgttgcgcaggacacagggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcggggtggccagccacattaggaaacttctgtgggggcccaccttcctcctgccctcgctgtgggattaagttagaccagtaggacacgcagcaacatccaggcacaaggaaaattccatggaaggtgaaagaagcaaagagcaagagaaagacagagtttgctgtttgcctgggatcccacagctggtcaaaggcagagccaggctgggagccgctgtccccagttcaggtctgcagggtgggtgaggacgtctttctcgccacactgcccactctccagtccagacaccctcagactctgcgagtgccaccctgtaacagtgaggggaaca

SEQ ID NO: 4325 - DNA, 1715 bp, Homo sapiens
gattcgctggcgcgacgggggcggggcctgggtgcgggtgccgcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcgccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4326 - DNA, 1307 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctggtcagtgtgtttcctgaccctctggtggggccactctttgcggggccctggggcttcactgggaggagccaagtggggcgtcagtgtgtgctacagtggctggggcagtgccccgcagaggcaggtgcgtgcccacagccgtcagcctttcttctggctgc

SEQ ID NO: 4327 - DNA, 1546 bp, Homo sapiens
gattcgctggcgcgacgggggcggggcctgggtgcgggtgccgcgtggcggccgcagcgctgaggggtgggtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatcta

SEQ ID NO: 4328 - DNA, 2451 bp, Homo sapiens
cttcagatgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctgaaccctgtgaaccccaggcaatgacagcaggatcctgaagcccatgcaggctctgaaccacgcggccatccagaaggggctgcaggcacctgccactactgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggctcaccggggtggctttgcgggcgtccagggcaccttctgcatgccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgtccccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggtgaaccaaagtgtcaagtagcgagcaggagggaagccgcgggctcaggggagatgaagtacaacgggagaggtcgctccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacatggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgta

SEQ ID NO: 4329 - DNA, 461 bp, Homo sapiens
ggggttaaacagagcccgtcttcaaggaaaggcagtttattgatttagttgttgatttagttattgatttagttatgaagctgtggattataaaaaggctggtttgaaagaaggaagccacattctgtgggggcctatgactgacacccctggggagagttgggccaaggctagctggcctgtgagcctcagcagcactgcagggggcctgggaggggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgct

SEQ ID NO: 4330 - DNA, 4641 bp, Homo sapiens
gcagtggggagagggcagggtgctaggctctgtcatcctgtggggctgggcccctgagacaaggcagaggacagcaggatgtcttagccccttgaccatccacggacccccaacccctgctggagcagtgcttgcacccccttctcccctggcacctgccagctggacccaacagcctctcctcccactccagtgcagccagcattgtcctggggccaccttggcaccacaggtttcctccctggcaaacctgcatgacggccttgcgtgccctcccccagggccaaggcgctgttgctgaactgaagtggcaacctacccggtcagagctttaagctgcagctctgatgccccagggacctctcagacccccctgcccagagcaggcagcccgcgggtgcagcccaaaactgtcttctgaggaagaggtgctctcctgggcccccactgtccccaggcctcaggtaagcccatcagggtcccaaggaagggggtctgggtttgaggccaaccatggcagctgacctactttctagcctcagtttcccctagtgtgtgcagctctcacgctgtttgggtgagaaccaggcctctgggcttggacattctttcagtgagtttttagggtggagggatgggaaatggaagcccaggacctcagcagggtgtcttcctccgatccggggacatctgcctgtgggaggctgggcccaccctcccttgctgacctgccctgggaggaagggacagggcccagcactgcctactcccctccctgttcttcccagcagtctgagcctggctgggtgtcccctgctcctccagcagcctacttgggcctttgggtagacagattaacagacaggcgaggctgggtcatggttggaccaccccaggaccctgaccgggggctcagctcatgaccctgagcctgggagagatgaggccatgccctccagggcactcagcatgacccggcccagtggacgggactgggtagcttccttggtgcagggggctgtcatgctaggacggggtcactgaccaggccaggcccctgccccatgacttgtggtggaaatgtccttttgtttttgtttttttgcattttttttgagacggagtttcactcttgttgcccaggctggagtgcagtggtgcaatcttgcctcactgcaacctccacctcctgggttcaagcaattctcctgcctcagctcctgagtagctgggattacaggcacctgccaccatgcctggctaatttttgtatttttagtggagatgggggtttcaccatgttggccaggctgttctcaaactcttcacctcaggtgatccacctgcctctgcctcccaaagtgctgggattataggtgtgagccactgcacccggccatgtgatgggaatgttctgtgtccataatagatgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaacggggcagggaggaggcagggcctgttctgcagttggacagacagagccctctagctgctttctggaagactgaagggcaggtgatgttggagggagggagtgcaggcaggggctgtgagggagttcaggtcagaaacaggtggcgcctggattcaggctgtggtggtcacggtggggatgaggggctgctttggattgtgctggggatgtggggtggtgcgctgctgcatgactactgccaggtctctctgctcttagtgtctgcatccagggctgggagggggtcaaatgaatcacactatcggccccaggcccaccaagcctggggaggtggccacccttccatgatggcatttggatgttccctgtgtgtggggagggcacagggactccattcgtagaccacctctgggacagtgtgtctgcctctgaggtcagacgctctgcactgggacagggtggagtggagggaaatccagcttggggctcattggaggggcttgctggcagacaccgccctttgtgggaaactgactgtgggagaggggaaccccaacctctgtcaccacatccctcttccctgttgtcacacctgtcacctgctgccatagccatgagacttcccaagggtcactgctgccactcactgcacagcctggaagggagtccacaggggacatacagtgagcaagagacctgtgccactcaggcctcctgggggtgtccccagtgcagccatgatgataatcacagctaccattcaccaagccctgcccacagtctaacctactctattcacaacactcccagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactctct

SEQ ID NO: 4331 - DNA, 2701 bp, Homo sapiens
gcagtggggagagggcagggtgctaggctctgtcatcctgtggggctgggcccctgagacaaggcagaggacagcaggatgtcttagccccttgaccatccacggacccccaacccctgctggagcagtgcttgcacccccttctcccctggcacctgccagctggacccaacagcctctcctcccactccagtgcagccagcattgtcctggggccaccttggcaccacaggtttcctccctggcaaacctgcatgacggccttgcgtgccctcccccagggccaaggcgctgttgctgaactgaagtggcaacctacccggtcagagctttaagctgcagctctgatgccccagggacctctcagacccccctgcccagagcaggcagcccgcgggtgcagcccaaaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactctct

SEQ ID NO: 4332 - DNA, 2593 bp, Homo sapiens
gcagtggggagagggcagggtgctaggctctgtcatcctgtggggctgggcccctgagacaaggcagaggacagcaggatgtcttagccccttgaccatccacggacccccaacccctgctggagcagtgcttgcacccccttctcccctggcacctgccagctggacccaacagcctctcctcccactccagtgcagccagcattgtcctggggccaccttggcaccacaggtttcctccctggcaaacctgcatgacggccttgcgtgccctcccccagggccaaggcgctgttgctgaactgaagtggcaacctacccggtcagagctttaagctgcagctctgatgccccagggacctctcagacccccctgcccagagcaggcagcccgcgggtgcagcccaaaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactctct

SEQ ID NO: 4333 - DNA, 1037 bp, Homo sapiens
aagtccccttaacctctttctgcctcagtcgactcacctggaaaacagagcacctacctccttcaaatgagaagagaagtaaaggagtataaggccatcagaacagtacctggcccaagggaggctatggaagtgcttgttgaataaaaaaatggcttcatctctggcctagccccaaaggtttgagttcctgccattgccacccagacagccctgggtggaggccctgctgacattgaagagtgcctgccctcctcccctcaatgcggtagacactttccaaaacttacgtcatcctcactctcactccagtgggataatgggaggcttggtgtacctcattcccaagatgagggaacaggctctgagaggaccacatcgccagcaagtgacaggctgggaccaaggccaggcctgtctgcctcctagactaggcctgagtgaggaccggcctgagtatggcccacctgcttcctcctccgtttagagcttgggctggagctgtcctggccagtgctctctgcctcaccaggctgcatgagccacaagctgccacttgtggagctcggtggccctgccctcgacagccttgctggtggtcgtgaaggctctaaacacctgcatggcaatgaggccaaccttctccgcttgatccgtttcaggctctggctccgctactgcatcgtgtgcttctgtccaagaggcagagagactgaaactatctgctgccgcctggattctcccagagattgcctggaacaccagctcgggtcctcgcacaccatcctggtaggaatctctcagtgacaattgagagtttgtgggctggcttagggccagtggtgggcagggagtcagcagggcgcaagggactggagagcttggcatttctccaacaggagtttcagggagagctcagaggcctgcttatgtgacaggtttatcagcttgcctggcccagggccggctctcataccgttttgatttaaataatagattgctcacagaataaatgtatgttggtttaagctttcact

SEQ ID NO: 4334 - DNA, 2250 bp, Homo sapiens
gcagtggggagagggcagggtgctaggctctgtcatcctgtggggctgggcccctgagacaaggcagaggacagcaggatgtcttagccccttgaccatccacggacccccaacccctgctggagcagtgcttgcacccccttctcccctggcacctgccagctggacccaacagcctctcctcccactccagtgcagccagcattgtcctggggccaccttggcaccacaggtttcctccctggcaaacctgcatgacggccttgcgtgccctcccccagggccaaggcgctgttgctgaactgaagtggcaacctacccggtcagagctttaagctgcagctctgatgccccagggacctctcagacccccctgcccagagcaggcagcccggtaagccctcctcctcttcccctgcagcctcagggctggagccacagctgggagggctcccagatcctgaccatatcctcccagaggctgagccaggcctgggcactgtcccctcaaatgtgagaatactgggcagggggaggggagaaaggagggaatggagggctgagcctggaggcatgaaaggggcaacctaggcagcggtatgggggagtgctcagagcttagagtcctgtggaaggcagagaactgccccagcccctgcctctcatcccccaccctctgtgtccctggccgagaggttcctggaggacatttttccagcaaaagagggagggtggtgtctgggcctagatccttggatgggcttttctctgcctgcttgtggggtgcctagggcgagtgggcttttggagacaatttctggcctaacctgacttggacagcagcccccagaggcacagctctcccctcaggcatgggggcatgattccacctcgctagcccacatgtgttcttcacggagggctgctggcccgtctccctggggttaccctgagcagcagagctgtgtttgttgagactccatggggtggagggattgcgatgttgtcctctcagttcccggggctgatgtggaagctcaagggcttgccctggattcttcagggtagccctgccatccctagtgagtcagtgagttgggaggttgggggctggagaatcaggtagggaggacacagctagacctcaggccctgatgggaacgtactaggctccaagtgggacctgccaggagacaagaattgatgacagccacacctttggagtctcaagccctctgccacccatgcggtggcctagttcaaatgacaggaacacaaggtccagctggcccaatgggcaggtagagggctgcagccagggctggaactggccttgcactgcctctgggcccttctctacccacccagtagtattgttcaagcccaggagggaaaaaggccagctcagggttaatgttacctcagcaagtagctgagtggcactgagcctcctggtagccactgtaaagaaggacacagaatggtttgggggcattcgctaggaggaaggaagcagatggatactctatggagacagaatgtcctctgtgtttgctctacaggaacgggttgtcaaccttctgcagggccaggaattgtcatgaggctgtagtaggcagcagagcttggcggggtgaggcgagatcacaggtataggctcagggcctggattcaaatcccctgggctgccacttgttggatgtgtaaccataggcagagtaaggacctgccatagcaaattaccacaaactcagtggcttaaagcaacagaatagttctggaggctaaaagtctgaaatccaagtataggccaagccacactccctttgaggactccaggggaagatccttccttgtctcttcagcttctggtggctcctggcaatccttggccttccttggctgctgctgcatcactccagtctctgaaaccatctaccctatgtgtctgtgtggccttcacatggcattccttatttttgcagtggggtctcactatgttgcccaggctggtcttgaactcctgggtccaagcagtcctcctgcttcagcctcccaagtagctgggattatgagtgagtgccaccatgcccggctcacatggcctccttgtaataacgctagtgcctgggtgcggtggctcacgcctgtaatcccagcacttttggaggctgcggtggacggaccatgaggtcaggaaattgaggccatcctgtccaacatggtgaaaccctgtctctactaaaatac

SEQ ID NO: 4335 - DNA, 9245 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccaggtaggtacaaaagggcctccatttctcattcctgccccagggccatctggagtgacacctttccgggaatcagcaggtgtgtctggagctcacctgtgtgcccagccctaacttaggctgttggttgcctcctgtgaaggttctgcggagttcccacccttgacttgtattccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 4336 - DNA, 11065 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtgaggaccttgagggtagtgggaagcagatggtcccaaggcttggcctggtggtatggacacagagtgtgaccttctaacgtggacactaccctcgtgtcttgacatgatctgcaccaagacaccacttcggctttttttcttggctttcaatctgggaaacaaaaagtaaaatcaacagtttctaggggaagcaatgcctggcaaaacatttccttctgcatgagaagtaactccccttggcatgtgccaatgcttctctttcagccccagtcttaggatttgttctcttattgaagtatcttgttttcaacaccagagccagagatttccttttcctgtcactgctgcatttgtccagaccaaaagaccttcctctcccaccccctaaaaccccttggtgcccatttcttgtctcacagaaattcttttctggccttaattttggtgattttgagtcctcgtattatgacttatttttgtgtcttcatctctaatgacaaggaggaattccgcaaggttaagtgcagttgtctctctcttttttttttttttttgagacagagtctcgctctgtcacccaggctggagtgcaatggcatgatcttggcttagtgcagcctctgcctcctgggctcaagcgattctcctgcctcaacctcccgagtacctgggattacaggcacctgccaccacgcccagctaatttttgtatttttagtagagacaaggtttcaccatgttggtcaggctggccttgaactcctgactcaggtgatctacccacctcggcctcccaaagtgctgggattacaggtgtgagccaccatgcccgaccatagtgcagttgtctcttatctgctgcatgtatgtgtgtacacacatgtggacatgggcttgtacatggacatatgtgactacagaagtctgtgtacacacacagccatgcacacatacatgctgctgtgtaacaccaccaatgtgggagagactggttgaaaacatggatctcaattctctttctatctatgcagtgattttcggtctctgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctctttgctgaattgaggcaaagaaagacagtgaccagcacatatgtgtgtttgtgtttttgtaaaagcacccacatgctcatgaggctaagagtgggttgtgaggacagatgggtggctgagcagggaggtaggcagagggacagagggaatgttcttctggaaaatcctcaggctcattgtgttctgcagaaggccagcagcactgcattattcaactcttcttgctggaatgcagattagaaactaagaatcttgccttcccactcattccctctttgagaccattgagctacatttctccttctacctggacccccttatccttaaattgaccatcagaacatttgcacccagactaagagccagagttcctgacacctggccataggcctgggccacctgaggctgcctttgcaggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctgggccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 4337 - DNA, 5849 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtgaggaccttgagggtagtgggaagcagatggtcccaaggcttggcctggtggtatggacacagagtgtgaccttctaacgtggacactaccctcgtgtcttgacatgatctgcaccaagacaccacttcggctttttttcttggctttcaatctgggaaacaaaaagtaaaatcaacagtttctaggggaagcaatgcctggcaaaacatttccttctgcatgagaagtaactccccttggcatgtgccaatgcttctctttcagccccagtcttaggatttgttctcttattgaagtatcttgttttcaacaccagagccagagatttccttttcctgtcactgctgcatttgtccagaccaaaagaccttcctctcccaccccctaaaaccccttggtgcccatttcttgtctcacagaaattcttttctggccttaattttggtgattttgagtcctcgtattatgacttatttttgtgtcttcatctctaatgacaaggaggaattccgcaaggttaagtgcagttgtctctctcttttttttttttttttgagacagagtctcgctctgtcacccaggctggagtgcaatggcatgatcttggcttagtgcagcctctgcctcctgggctcaagcgattctcctgcctcaacctcccgagtacctgggattacaggcacctgccaccacgcccagctaatttttgtatttttagtagagacaaggtttcaccatgttggtcaggctggccttgaactcctgactcaggtgatctacccacctcggcctcccaaagtgctgggattacaggtgtgagccaccatgcccgaccatagtgcagttgtctcttatctgctgcatgtatgtgtgtacacacatgtggacatgggcttgtacatggacatatgtgactacagaagtctgtgtacacacacagccatgcacacatacatgctgctgtgtaacaccaccaatgtgggagagactggttgaaaacatggatctcaattctctttctatctatgcagtgattttcggtctctgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctctttgctgaattgaggcaaagaaagacagtgaccagcacatatgtgtgtttgtgtttttgtaaaagcacccacatgctcatgaggctaagagtgggttgtgaggacagatgggtggctgagcagggaggtaggcagagggacagagggaatgttcttctggaaaatcctcaggctcattgtgttctgcagaaggccagcagcactgcattattcaactcttcttgctggaatgcagattagaaactaagaatcttgccttcccactcattccctctttgagaccattgagctacatttctccttctacctggacccccttatccttaaattgaccatcagaacatttgcacccagactaagagccagagttcctgacacctggccataggcctgggccacctgaggctgcctttgcaggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgccgtgagtactgacgccctcatgttctcagatgccctcccttcttcccatgtgtctatgcttgaagaccttgtgagtgcagggggatatcttcatgggcgagagaagacagagtgttagtagggactggatggccaagggctaaggagggttaagacattggctgtgtaagaagtttatattacgggtgaggtgggacatggattcaaggcatgaacatgtggagacttttcttctggagagattctggcaggggagaagagggaatactgatgaaaagaaggaagtcgatttatgtctttaattaggcgtgattatatttgccaatatgagtgatcaactcatacattcatgtctatagaatcttgcttctttggacagaagcaacttaatgtttttatgtagaaaactgggccgggcacagtgact

SEQ ID NO: 4338 - DNA, 4420 bp, Homo sapiens
ttattttgttgctcttcttgacaagagtgtacttggtgtagggcctcacaatttggagttgattgatcttttttttttctttcttgagatggagtcttgctctgttgccaggctggagtgcaatgtcacgatctcggctcactgcaacctccgcctcctgggttcaagcgatttccctgtctcagcctcccgagtagctgggactgcaggcacgtgccaccacacccagctaatttttgtagttttagtagagatgggatttcatcatgttggccaggatggtctcgatctcttgacctcgtgatccgcccacctcggcctcccaaagtgctgggattacaggtgtgagccaccgtgcctggcctggaggtggttgatctttaagattttctctacccttgggcgtctgtaagactggacaggccatcagcgtgaaacaaactctggtctatgaagtccggactagctggtggggctgggaggtagttcccttcgttcatctctagttcagttatcagctagccagtttactgttgctatatctcaatccttcaagcatttaactggtcggaagagtctacatagcagccctgttcataggatacaagctgtaaaactgggactccacttctggtctgtgttctgggtgtgggggctttattatacactgtcttcttgtttcatggttctgcagattgtttcgtcatctccatggagtcaagctcatggtttgaagtggctttgtgaaccaaacactgtctctgactttacccactcctctttccttccagcgtgatgagacgctccaggatggctgtgatactcacttctgcaaggtcaatgagagaggagagtacttctgggagaagagggtcacaggctgcccaccctttgatgaacacaagtgtctggctgagggagtgagtactcattctgctttcctctttactgtctcaatctctaagaacaagattcttctgaatagtgtgcatcccagctccggcataatttctcagtgtctgaggcacatctctggcctagttgaagaatcagtgagattacgaaatcaaagcctacggagagataaaattctctgcaatataggatgttttaaaaaaatattttccttaagggaggctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgcaattttgctgttttcttagggtaaaattatgaaaattccaggcacctgctgtgacacatgtgagtgcgttactaatatcttgtcccttgaaacccatcagagcaagtccaggggctctttgcagcttgctccttgaaacccattagcaagccgcatgactgttctttggagtaagctttatttcagaaagatatttcgtgaccactggtcagtcattatgttcagtcttgcagggagcagcctcccctccttggatgtcatcagactgccctcttgaactcccttttagatcccatggagcaatctctttccccttttcctgcaaactccctcctgtctccagcttcttatgtgccttttccctcataggatctttgattgctcatagtcctatcctgggacgatatgttccctctctaaccaaagcttcttgaagacaggcaccttggatctatgatcctgacagagtagactctcaacacatatctattcatgagtgtgctaaagctatctcaaagagaaagcgaagccaccagctggctgacaacagcccacatgtgctgtgggggctggtctaagtttatcaccccctcttcttcactctgagctcctctttacctcgtagttatgtcctactgattggttctcattgctcacagcagcagctttggagacgagacacaaatctgcacatcagacagtgttcttcccatacatgcttgtgtttgtgagcacaaataactttcaggatcccaatgctaatgccataatttctgaatatagaattacttgcctggactaagattttttgttttagattagggtatttcttttctgccctgggttcacaggtccatgcttgtttacagatagagaaaggaagagtgaaaacatgaatactttcagtgttcaatcattcattcttgacagcccctgcaattgctgtaaccaaatctcagatcgaggaagcactctgaaagcatgtctttctatgattcccatttgaatggtttaagaatgtgaagtcaggaaaccatcagagaagaagaattctctctaggcacactgcacgtggaatttgattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatctaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtacccgaagagaggccttcacaaaggtgcctagggatcttctcggtccccagagaggcagggtatgcccttacatcaccatgacttcgcctttcctcttaccccaaggcaggaatgaagagatagtaattatacttattgactacttcattgcccattagcttctgaatgtagttacaagcacaagagggttgctttagccatgtggtttttagagtctacaatgatacaaaggcaagtcttcctcattttacatcaccatagcacagtgaatttaggctcttcctgcaattaaaattgtaccattaagtgagttaagtccagcaataactatatctctgcatatttcgggccaggaacagctgaggtgaaccaggataactgaattccctccctgtggctggctttatttggttactgtgaaagggacctatttccagcccagtgagggcactggggctgaagagtgttctctagaaccccagccagtcctcaagtttcatctctcacctgtcctgtaggtgaggagcctgagtgcaacgacatcactgccaggctgcagtgggaagctgtaagtctgaagtagaggtggatatccactactgccaggtaagggctctgcttcaataagggctgggtgtggagggctgagcctccgtgttcggatacctatccttagttacattctagaaggatctggaaaattcgcagggaagagaagggaaataaactggaagcatttttttttaagcaaatgttttattgaagtaactggaaatttttgactccaggaaaaaaacaaaaatggaggaaagactcagcaaatcctttacagaaaatggagagttatttatgcaagatgggggccacaattcttgaagatcagtcaaacatatataaaattttcctgcataaaacatgcataatcaggcataaaacattttatgcattaacatgcataaaaattgcagctagaggggtgtgggtatgatattattaccatagagaagaggacatgtcagacctatgatcttcctttacaaattgcctagctgtcctgggtgcttctgggtgagatcagacctgccttgcttggagggggtcagggagaaagcaggctgccccagagccctgcctaagccaggacttcccaccattgtgaagctcccatcttcctctgctttcttgcagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 4339 - DNA, 2222 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgagtatgtgaacccgggggcaaggcagggacctcgcagaatctcgaggtctccacattagtgcagtgcgttccggaggcagtgctcccaccgcggagggcgggggcggggagcgaggaaaggggtcgggctttgtttttaccgtcagcacttgatcatctgaactgggccatttgctcttcaaagtccctttattgggcgcccgccacaggccaacccccgggaaagaaaaaaaaaaaaaaag

SEQ ID NO: 4340 - DNA, 1086 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaaggtgggtgtggactggcctgggtgcacctggatggtgtgtgatttctggatctaaaagacagaaggactcagtctcatatccttccatctgggggaggaatggacttacgcagggccatttcctccaaaactaactgtggctagagtctaattctaatacatctcgagcctgaagctct

SEQ ID NO: 4341 - DNA, 1758 bp, Homo sapiens
cctcatttagcttaagttctaatggagagagacagacaataaacaaagcaaacaagtaaattatattatagatcggaaagtgatagatcctgggggaaataaagcagagaaaggggcaggatgtgccaggattggggggatttaaattttaaataaggaggtgggagaaggcctaatgtgacaacatttggtatttgtcaagcaaacaaggaaacattactctgtcccctttcttaacagtgtttacttgggttcgatttctatgggcctgggaccttctactggattgttaaccctgcattttgttaggttggagctggaagctgaaaaggggctctaagagctgaccctagcccctgagggattcagaacgcagggaggtcatcccaccttggtaatgacatgcggagagggagtcaggactcctgggtcccagcccccgctccaccttcaaatcggggtcctctccgtagaaaccagcagatgcccccagctgtgtgggggaagggcgggctccactctgctggttgttcccgaatgtgcactttgggctcagaactttgttcagttctgagaatggacagtaaaccacatgctcatggcctggagtttgaactgtgccgctgctttgctgctgtcaccctggcaggctgcctcagagcctctgcagactcctactcctatccatcatcaccctcagagtcttctgtggctcgtggccctttctcttcagtgatgcccagggcctgagtggcaggcagcaggttgtggggaggtgtttcttgtcattaaccgtgagctcccggagggcttggaccacacctggcagcctgctgggcccacaccgagtgaccaacgcgaagtctttctatatagaggggccttgagtttgcacgtaactctgggtgggggggtcaggcccactggtgtggatggcacagagggcagagtgcttcgggctgggctcaacctgcctactcaccctagctccgccactacctccctgaccttaggcaagtcactttgcctctttgggcctcccttctccatccttagatgatctgataatttctaaaatctcttgtggcagtacagggctctgatgatttgggaacagggatggagctggtaaatttacactgcagttcactttcccccgcccccccttttgcagcctagggcttagctgccttttattacattcatatttatgtttcacccggggaacttttttttttttattaaaaccatctcattagctaaacaactatgccgctgctttcgcggcagcggctccagagtggcctggtctctcctgcagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgagtatgtgaacccgggggcaaggcagggacctcgcagaatctcgaggtctccacattagtgcagtgcgttccggaggcagtgctcccaccgcggagggcgggggcggggagcgaggaaaggggtcgggctttgtttttaccgtcagcacttgatcatctgaactgggccatttgctcttcaaagtccctttattgggcgcccgccacaggccaacccccgggaaagaaaaaaaaaaaaaaag

SEQ ID NO: 4342 - DNA, 9690 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccaggtaggtacaaaagggcctccatttctcattcctgccccagggccatctggagtgacacctttccgggaatcagcaggtgtgtctggagctcacctgtgtgcccagccctaacttaggctgttggttgcctcctgtgaaggttctgcggagttcccacccttgacttgtattccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctgggccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 4343 - DNA, 9515 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctgggccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 4344 - DNA, 9780 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctgggccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggagtgagtactcattctgctttcctctttactgtctcaatctctaagaacaagattcttctgaatagtgtgcatcccagctccggcataatttctcagtgtctgaggcacatctctggcctagttgaagaatcagtgagattacgaaatcaaagcctacggagagataaaattctctgcaatataggatgttttaaaaaaatattttccttaagggaggctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgcaattttgctgttttcttagggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 4345 - DNA, 6194 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctgggccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagtaagaatctggtgtacagtcctcaattcaggagagcgagac

SEQ ID NO: 4346 - DNA, 9278 bp, Homo sapiens
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggagggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctgggccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgtgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtggtaagagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 4347 - DNA, 3093 bp, Homo sapiens
ggcaggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatgattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagaatatgggaagttggcgagcccctttcctggtagctgggacctatttcaccttgtacagaaacttggaggtttgcccctgaccaccctcgagatcgtgcagcactgactggctactgctctcggttctccaggtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 4348 - DNA, 2908 bp, Homo sapiens
actgcaacctccacttccctgggcttgagtgatcctccccacctcatcctcccaggtagctgggaccatagatgcattccaccgcaccctactgattttttgtatttttggtagagacagggtttcaccatgttgcccaggccaatctggaacttctgggttcaaggaatccgcctaccttgacttcccaaagtgctgggattacaggtgtaagctactgtgcctggctgaggttattttattttacttttttttgagacagagtctcgctctgtcgcccaggctggagtgcaatggcatggtcttggctcactgcagcctccacctcccaggtttaagtgattctcctgcctcagcctccccagtagctgggattacaggcatgtgccaccacgcctaggtaatttttgtatttttagtagagatggggttttaccatgttggtcaggctggtgtcgaactcctgacctcgtgatctgcccacctcagcctcccaaagtgctgggattacaggcgtgagccaccatgcccagccgaggttattttttaatatcctttggtgggctgaagctagtgaggcccacatggggaggggtctgatctttataaactgggttccacccccataccataggttggctagattcctgcattagtaaaaatcatgaaagtagtgctgaaactcttgtaggcagcagagtgagaaaaatgggaacaaaatccagtgctcccttcttgtgctctggagtatctaatggaggatgcaggggtcctagtgttagatcttggcctctgactgggccagacatgggattggaaggggtgggagttctggacaagctcgcttttgaaattgctctgaccctttgctgttggttgcctcctctcatccgcttgcagatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 4349 - DNA, 2360 bp, Homo sapiens
ggcggaagcgagggcggggacagcggaatgacgttttaaggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggagtgcatcagggccctgggacagaacaaggctcacaccccgttccgtgagagcaagctgacacaggtgctgagggactccttcattggggagaactctaggacttgcatggtgagtagggtcactttgaaggtgatggtacaggaggagacagagttgctttccacagagacacttagtcctgtccctgggctggaagctcagcactgctggctgcctgggtttccaggctgtaccgtgactgggcttccagaccctgctttaatgcacgagactccttgtggcctaaccaagcgtggaggaaaggatctattccctttaagatgtgtaggtgcagctcttggtttgggagaggtcattcctgcattacctgatgaaaagggggttccagaattcggaagatgggcctttgggtcagcaggagagggaagtccttgtcttttccatggcctccctcaggttcactggctcccagcctagaaaatagaaatagcctggatcataaggctgtgtccttgaatgacgtcctctttcctgttttatccccaagcccctgtatgtgagatctgccatccttcccctcaagagaatattctcccctaccctttgggtaggagtcctttcatgaggaa

SEQ ID NO: 4350 - DNA, 2467 bp, Homo sapiens
ggcggaagcgagggcggggacagcggaatgacgttttaaggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggtagtggggcagctagagctggttggccgggagagctactgggaagggatggggagggatcagtgcaaggaaagaagggacctcagttgttcctgctgcccccacaggagtgcatcagggccctgggacagaacaaggctcacaccccgttccgtgagagcaagctgacacaggtgctgagggactccttcattggggagaactctaggacttgcatggtgagtagggtcactttgaaggtgatggtacaggaggagacagagttgctttccacagagacacttagtcctgtccctgggctggaagctcagcactgctggctgcctgggtttccaggctgtaccgtgactgggcttccagaccctgctttaatgcacgagactccttgtggcctaaccaagcgtggaggaaaggatctattccctttaagatgtgtaggtgcagctcttggtttgggagaggtcattcctgcattacctgatgaaaagggggttccagaattcggaagatgggcctttgggtcagcaggagagggaagtccttgtcttttccatggcctccctcaggttcactggctcccagcctagaaaatagaaatagcctggatcataaggctgtgtccttgaatgacgtcctctttcctgttttatccccaagcccctgtatgtgagatctgccatccttcccctcaagagaatattctcccctaccctttgggtaggagtcctttcatgaggaa

SEQ ID NO: 4351 - DNA, 2140 bp, Homo sapiens
ggcggaagcgagggcggggacagcggaatgacgttttaaggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaaggtagtggggcagctagagctggttggccgggagagctactgggaagggatggggagggatcagtgcaaggaaagaagggacctcagttgttcctgctgcccccacaggagtgcatcagggccctgggacagaacaaggctcacaccccgttccgtgagagcaagctgacacaggtgctgagggactccttcattggggagaactctaggacttgcatgattgccacgatctcaccaggcataagctcctgtgaatatactttaaacaccctgagatatgcagacaggtactagtacctacagctaggtgggatgcggaacaggactgggcaagggaagggcagtgatgagaggggaggaggctctggggcctcagggcctactgtatactcctctgtgactctgaacctgag

SEQ ID NO: 4352 - DNA, 1922 bp, Homo sapiens
ggcggaagcgagggcggggacagcggaatgacgttttaaggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatggtttaattcacagtgccaatgtaaggactgtgaacttggagaaatcctgtgtttcagtggaatgggcagaaggaggtgccacaaagggcaaagagattgattttgatgatgtggctgcaataaacccagaactcttacagcttcttcccttacatccgaaggacaatctgcccttgcaggaaaatgtaacaatccagaaacaaaaacggagatccgtcaactccaaaattcctgctccaaaagaaagtcttcgaagccgctccactcgcatgtccactgtctcagagcttcgcatcacggctcaggagaatgacatggaggtggagctgcctgcagctgcaaactcccgcaagcagttttcagttcctcctgcccccactaggccttcctgccctgcagtggctgaaataccattgaggatggtcagcgaggagatggaagagcaagtccattccatccgaggcagctcttctgcaaaccctgtgaactcagttcggaggaaatcatgtcttgtgaaggaagtggaaaaaatgaagaacaagcgagaagagaagaaggcccagaactctgaaatgagaatgaagagagctcaggagtatgacagtagttttccaaactgggaatttgcccgaatgattaaagaatttcgggctactttggaatgtcatccacttactatgactgatcctatcgaagagcacagaatatgtgtctgtgttaggaaacgcccactgaataagcaagaattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacaggttcacagcaaggccactggtacagacaatctttgaaggtggaaaagcaacttgttttgcatatggccagacaggaagtggcaagacacatactatgggcggagacctctctgggaaagcccagaatgcatccaaagggatctatgccatggcctcccgggacgtcttcctcctgaagaatcaaccctgctaccggaagttgggcctggaagtctatgtgacattcttcgagatctacaatgggaagctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcagaacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaagattgccacgatctcaccaggcataagctcctgtgaatatactttaaacaccctgagatatgcagacaggtactagtacctacagctaggtgggatgcggaacaggactgggcaagggaagggcagtgatgagaggggaggaggctctggggcctcagggcctactgtatactcctctgtgactctgaacctgag

SEQ ID NO: 4353 - DNA, 1222 bp, Homo sapiens
gtcccaatcctctccgggccctgctggagagtcagctgggtgaggggcttttccagtccagctttagttttctctctccttggctgaaggcaaggttgccattccatccccttggagcctcaagcctcgaagcctgggcggtgccacattcctctggtgagtaccaagggggtgctgtgggatctgagacctccttgtttcctcagggtcaaggagctgagcccccacagtgggcccagtggagagcagttgattcaaatggaaacagaagagatggaagcctgctctaacggggcgctgattccaggcaatttatccaaggaagaggaggaactgtcttcccagatgtccagctttaacgaagccatgactcagatcagggagctggaggagaaggctatggaagagctcaaggagatcatacagcaaggaccagactggcttgagctctctgagatgaccgagcagccagactatgacctggagacctttgtgaacaaagcggaatctgctctggcccagcaagccaagcatttctcagccctgcgagatgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccagggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtggactggctgctaatggagagctccctggggttgtcctggctctggggagagagacggagcctttagtacagctatctgctggctctaaaccttctacgcctttgggccgagcactgaatgtcttgtactttaaaaaaatgtttctgagacctctttctactttactgtctccctagagatcctagaggatccctactgttttctgttttatgtgtttatacattgtatgtaacaataaagagaaaaaataaatcagctgtttaagtgtgtggaaag

SEQ ID NO: 4354 - DNA, 4011 bp, Homo sapiens
cacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcatccgcatccccccataccactatatccatgtgctggaccagaacagcaacgtgtcccgtgtggaggtcgggccaaagacctacatccggcaggacaatgagagggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaaggacatcacacccctgcaggtggttctgcccaacactgccctccatctaaaggcgctgcttgattttgaggataaagatggagacaaggtggtggcaggagatgagtggcttttcgagggacctggcacgtacatcccccggaaggaagtggaggtcgtggagatcattcaggccaccatcatcaggcagaaccaggctctgcggctcagggcccgcaaggagtgctgggaccgggacggcaaggagagggtgacaggggaagaatggctggtcaccacagtaggggcgtacctcccagcggtgtttgaggaggttctggatttggtggacgccgtcatccttacggaaaagacagccctgcacctccgggctcggcggaacttccgggacttcaggggagtgtcccgccgcactggggaggagtggctggtaacagtgcaggacacagaggcccacgtgccagatgtccacgaggaggtgctgggggttgtgcccatcaccaccctgggcccccacaactactgcgtgattctcgaccctgtcggaccggatggcaagaatcagctggggcagaagcgcgtggtcaagggagagaagtcttttttcctccagccaggagagcagctggaacaaggcatccaggatgtgtatgtgctgtcggagcagcaggggctgctgctgagggccctgcagcccctggaggagggggaggatgaggagaaggtctcacaccaggctggggaccactggctcatccgcggacccctggagtatgtgccatctgccaaagtggaggtggtggaggagcgccaggccatccctctagacgagaacgagggcatctatgtgcaggatgtcaagaccggaaaggtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaaggtgcgcgctgtgattggaagcacctacatgctgacccaggacgaagtcctgtgggagaaagagctgcctcccggggtggaggagctgctgaacaaggggcaggaccctctggcagacaggggtgagaaggacacagctaagagcctccagcccttggcgccccggaacaagacccgtgtggtcagctaccgcgtgccccacaacgctgcggtgcaggtgtacgactaccgagagaagcgagcccgcgtggtcttcgggcctgagctggtgtcgctgggtcctgaggagcagttcacagtgttgtccctctcagctgggcggcccaagcgtccccatgcccgccgtgcgctctgcctgctgctggggcctgacttcttcacagacgtcatcaccatcgaaacggcggatcatgccaggctgcaactgcagctggcctacaactggcactttgaggtgaatgaccggaaggacccccaagagacggccaagctcttttcagtgccagactttgtaggtgatgcctgcaaagccatcgcatcccgggtgcggggggccgtggcctctgtcactttcgatgacttccataagaactcagcccgcatcattcgcactgctgtctttggctttgagacctcggaagcgaagggccccgatggcatggccctgcccaggccccgggaccaggctgtcttcccccaaaacgggctggtggtcagcagtgtggacgtgcagtcagtggagcctgtggatcagaggacccgggacgccctgcaacgcagcgtccagctggccatcgagatcaccaccaactcccaggaagcggcggccaagcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaacttatct

SEQ ID NO: 4355 - DNA, 1256 bp, Homo sapiens
cccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccaggcatgaggctcagagactggagcaggaagcccgcggccggcttgagcggcagaagatcctggaccagtcagaagccgagaaagctcgcaaggaacttttggagctggaggctctgagcatggccgtggagagcaccgggactgccaaggcggaggccgagtcccgtgcggaggcagcccggattgagggagaagggtccgtgctgcaggccaagctaaaagcacaggccttggccattgaaacggaggctgagctccagagggtccagaaggtccgagagctggaactggtctatgcccgggcccagctggagctggaggtgagcaaggctcagcagctggctgaggtggaggtgaagaagttcaagcagatgacagaggccataggccccagcaccatcagggaccttgctgtggctgggcctgagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaacttatct

SEQ ID NO: 4356 - DNA, 4483 bp, Homo sapiens
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgaggtgagtgcccaacatagcacagcaccctcatcacccctaattctgccaggagcccctccagatccccagcccctcttcagctcccttggcccccagtcctgcctggcctgggacccagagcagctccagctgccccaccagaagggaaggggcagagggacaggggtggctacagctccttggtcctgggcccaggaagccccgcccagggggctgcagtcttgcccccggccacagcctagactgcgggacacagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaa

SEQ ID NO: 4357 - DNA, 3515 bp, Homo sapiens
cagcactttgggaggctgaggcgggcgcatcacctgaggtcaggatttcaagaccagcccggccaacatggtaaaaccccgtctctactaaaaatacaaaaattagctgggcgtggtggcacatgcctgtaatcccagctactcgggaggccgaggcaggagaatcacttgaacctgggaggcagaggttgcagtgagccaagatggcgccattgcactccagcctggccaacagagcaagactctgtccaaaaaacaaacaaacagacaaacaaacaaaacaaaaagaaatagagacacagagaagtggaagcggggcggcacagaggggattggagggggggacctgggccccagccacagccacagtagcttggcctgggggagcagggtgcgggcggtggggtggccggggctgaggggtggtgctcagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaa

SEQ ID NO: 4358 - DNA, 4525 bp, Homo sapiens
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcggtgaggccggccggggtccaagctggagaacacagaggggcagccccaaggagggcccatccgttcgctcattcagccactcgacaaacatcacgggcatgctccctgagccgagcggcaacaggacaggtttttctgcccaaaaggagccccgctctgggggagatggaggcagatgcatccagcagatttcctgcgacactgctgtacatgagccatgtccagagtgccgtgggagcactgagcagagagccatccctgtgcctgggggtgatgcctttaggaggctgagaagatgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaa

SEQ ID NO: 4359 - DNA, 4417 bp, Homo sapiens
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacagcctttcagaagaagctggagccggcctaccaggtgagcaaaggccacaagatccggctgaccgtggaactggctgaccatgacgctgaggtcaaatggctcaagaatggccaggagatccagatgagcggcagcaagtacatctttgagtccatcggtgccaagcgtaccctgaccatcagccagtgctcattggcggacgacgcagcctaccagtgcgtggtgggtggcgagaagtgtagcacggagctctttgtgaaagagccccctgtgctcatcacgcgccccttggaggaccagctggtgatggtggggcagcgggtggagtttgagtgtgaagtatcggaggagggggcgcaagtcaaatggctgaaggacggggtggagctgacccgggaggagaccttcaaataccggttcaagaaggacgggcagagacaccacctgatcatcaacgaggccatgctggaggacgcggggcactatgcactgtgcactagcgggggccaggcgctggctgagctcattgtgcaggaaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcgggtccacaaactgaccattgacgacgtcacacctgccgacgaggctgactacagctttgtgcccgagggcttcgcctgcaacctgtcagccaagctccacttcatggaggtcaagattgacttcgtacccaggcaggaacctcccaagatccacctggactgcccaggccgcataccagacaccattgtggttgtagctggaaataagctacgtctggacgtccctatctctggggaccctgctcccactgtgatctggcagaaggctatcacgcaggggaataaggccccagccaggccagccccagatgccccagaggacacaggtgacagcgatgagtgggtgtttgacaagaagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgaggtgaggagccctcggggccagggcctgggagatgggaagagcgggcggcagtggggaccctgggctttgctccgttgtcctcggccaagcacctgccctggctgcaagggcacggaccctgccacgcccagatgggcaatagcttccagaaggctgggaggacacagtgacatggcctcctcttctgcagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaa

SEQ ID NO: 4360 - DNA, 2359 bp, Homo sapiens
ctgacttggatctcaccccaactctgcacccccccagctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcggtgaggccggccggggtccaagctggagaacacagaggggcagccccaaggagggcccatccgttcgctcattcagccactcgacaaacatcacgggcatgctccctgagccgagcggcaacaggacaggtttttctgcccaaaaggagccccgctctgggggagatggaggcagatgcatccagcagatttcctgcgacactgctgtacatgagccatgtccagagtgccgtgggagcactgagcagagagccatccctgtgcctgggggtgatgcctttaggaggctgagaagatgacgtgccagacgcacctgcggcccccaagatcagcaacgtgggagaggactcctgcacagtacagtgggagccgcctgcctacgatggcgggcagcccatcctgggctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcggtccccccagcgaacccacccacctggcagtagaggacgtctctgacaccacggtctccctcaagtggcggcccccagagcgcgtgggagcaggaggcctggatggctacagcgtggagtactgcccagagggctgctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgcaacggccacggcttcagctgcccaggcacctgcgccagaccattcagaagaaggtcggggagcctgtgaaccttctcatccctttccagggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttgacaagccaagtcctccccaggatctccgggtgactgacgcctggggtcttaatgtggctctggagtggaagccaccccaggatgtcggcaacacggagctctgggggtacacagtgcagaaagccgacaagaagaccatggagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccaggcatcacctatgagccacccaactataaggccctggacttctccgaggccccaagcttcacccagcccctggtgaaccgctcggtcatcgcgggctacactgctatgctctgctgtgctgtccggggtagccccaagcccaagatttcctggttcaagaatggcctggacctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgagtgcctcagtgaccaggctggctcctggggatggccaggtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaa

SEQ ID NO: 4361 - DNA, 3545 bp, Homo sapiens
agtccctctttgggtgacctgtgcctgcttcgtgcctggtgtgacgtctctcaggatgcctgagccggggaagaagccagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcagagaaggcagagcccatgctggcccctgcccctgcccctgctgaggccactggagcccctggagaagccccggccccagccgctgagctgggagaaagtgccccaagtcccaaagggtcaagctcagcagctctcaatggtcctacccctggagcccccgatgaccccattggcctcttcgtgatgcggccacaggatggcgaggtgaccgtgggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtctatctgttcgagctgcacatcaccgatgcccagcctgccttcactggcagctaccgctgtgaggtgtccaccaaggacaaatttgactgctccaacttcaatctcactgtccacgaggccatgggcaccggagacctggacctcctatcagccttccgccgcacgagcctggctggaggtggtcggcggatcagtgatagccatgaggacactgggattctggacttcagctcactgctgaaaaagagagacagtttccggaccccgaggtgagtgcccaacatagcacagcaccctcatcacccctaattctgccaggagcccctccagatccccagcccctcttcagctcccttggcccccagtcctgcctggcctgggacccagagcagctccagctgccccaccagaagggaaggggcagagggacaggggtggctacagctccttggtcctgggcccaggaagccccgcccagggggctgcagtcttgcccccggccacagcctagactgcgggacacagggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacaggttagcccttcctcagaggggagaggagagggcacaggctagcccttccctacacaggagaggagagggcataggttagcccttccccacaggggagaggagagggcacaggttagccccccacctcgtccacatacatggaaagagcggagtccggcttagcacagagactcacaggaaagaagagcccaggttaacccctccttgtgtagaaaaagccaagaatgcccaggttagccccttaccacagagatagaagagaagagcaaaagttaggccaggacagccacaaggaaaaggacagagctcaggttaaccctcctcaccaaggaaaaatcaggctacactttctttctctaccctcttctgaaaagaaatgaagcccggttaaccctctccacacccaaaagaaaagggaagaggcccgctaagcctggagagccacacacaggcaaagaaaagagcctggctaatctttctctcaggcaaacaaagcaggagggcttgggttaactaccctcacccccaggcagatggaaagaggagagcccaggaatagcccttctccactgaggggttgacaagggcgggtgtgagccgggaaagcaggggtctcacatgccttctccccaccatgtctgggtctagcacagggcctggcacacacctcgagcgctctataaacaccgactgaatggaggggtcagcttccatgcaggatatgggagacaagcccctcccaaagcacacacacaaaacacacacgatcatggggacggggagaggagctggttagtccctccctgctgacctcccccaggccccttatccctctgccctgcctccctgttgtctcagcctcactgggtttcccatcaccccatcgctaggtggcctggcccttaccggcaccgtggccccatttaagccagggatcccctgaatgccaccaatgttcctctgggttaactcctgaactgctgagcccagagggcaccaagcaaaggactgtaggtgcccaaggaggaaaagatggaggctggcaaggcagatggggacctccgagggtaggggtgtcttccaggaatagcaacaacagtaaaaagagcaaattgctggccaggtgcagtggctcacgcctgtaatcccagcactttgggaggccgaggcaggtggatcacctgaggttaggcgttcaagaccagcctgaccaacatggtgaaaccccgtctctactaaaaatacaaaattacctgggcatggtggcaggcgcctgtaatcccagctactccggaggctgaggcaggagaatcacttgaacccgggaggcagaggttgcagtgagtcaggattgtgccattgcactccaacctgggtgacagaatgagactccatctcaaaaaaagtgagtgagttccttcctaagccagccactaggtgctttatgtaattatctcatttaattctcgaaacaacactatgatggaaggactattaccatttccatgttactgaggaaaccgaggcacagagggtttaaggaactagcgcaaggtcacagagcacccagcagtagatctctgcccctccgcagctgactccaggcccagccagagtatttgaggactcaggggtccttctctgctcggtggatggagcccccacttcctccctgggctcagcagcagcaacatgggcttttacaaacacggccgcaagaggaggcattgttgtggagcagggctgggctcaagacccagctctgccacacacctgctgggctggtggcattgggccagtcgcctctctgagccctatttcccccactgcagcagcatggggaccaccgcactggccctgggggctgagatgggagtgagagtgctgggcacagagggctgctaggtgggagcgcctgggaagagtacacaactcaggggttgctgagagaagagaaggcacagctgtcccagccccagttctcctgacaagcttctgtctttctggaagcccctaacccaatccctgagctgagcaggtggagaggaccccaaggaagacagaaggacaaggtcagacagacagagacaaggaggtgggttgacacatagacacagataaagaaatgaagacaccatgcctgt

SEQ ID NO: 4362 - DNA, 5807 bp, Homo sapiens
ggagggaggcacaggcgcttgctttgcaggagtcagctctgccttcctcggctggagtgtgggtggcttggtgagccggtggtcaggaattctctctcctccttgcaattttcctttctgtctgggagcacgccaagatgtcccttgtgactgtccccttctaccagaagagacataggcacttcgaccagtcctaccgtaatattcaaacacggtacctgctggacgaatatgcgtcaaaaaagcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcaggtaccagtccctggtggccgcctatggtgaggccaagcgacagcgcttcctcagcgagctggcccacttggaggaggatgtccacctggcacgctcccaggcccgcgacaagctggacaaatacgccattcagcagatgatggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtggtacaaagatggcagtctgatttgccaggcggctgaaccgggaaagtacaggattgagagcaactatggcgtacacacactggagatcaacagggcagactttgacgacactgcgacatactcagcagtggccaccaatgcccacggacaagtgtccaccaacgcggcggtggtggtgagaaggttccggggagacgaggaaccattccgttcggtgggactcccgattggattgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatgacgtgctgttgaaagagtccaagtggacgaagatgttctttggagaaggccaggcctccctgtccttcagccacctgcacaaggacgacgagggcctgtacaccctgcgcatcgtgtctcggggcggcgtcagcgaccacagcgccttcctgtttgtcagagatgctgacccgctggtcacaggggcccccggtgcacccatggacttgcagtgccacgacgccaaccgggactacgtcatcgtgacctggaagccgcccaacaccaccactgagagccccgtcatgggctattttgtggaccgatgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaagccgttcatttggagggagagaaggagattgccatttatcaggatgaccttgaaggtgacgcccaggttccagggcctcccaccggtgtgcacgcttccgagatcagcagaaactatgtcgtcctcagctgggagccacccactccccgtggcaaggacccgctcatgtacttcattgagaagtcggtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccgttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccatcggatacaacaggttcgtggtgcacggcttaaccacgggagagcagtacatcttccgagtcaaggcggtcaatgctgtggggatgagtgaaaattcccaggaatcagacgtcataaaagtgcaggccgcactcaccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacggtggacggcttgacggaaggctcactctacgagttcaaaatcgccgccgtcaacctggccggcatcggggagccctcagatcccagtgagcacttcaagtgtgaggcctggaccatgccggagcccggtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtcaatcagacgacaacagccaaccgttatttaaaggtctctgacctgcagcaaggtaagacctatgtcttcagggtccgggcagtcaatgcaaatggcgtggggaagccctcagacacgtcggagcctgtgctggtagaggcgagaccaggcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaattgaaaccgtgggggatcactccaagctgtacttaaagaatccggataaggaggatttagggacttactccgtgtctgtaagtgatacagacggagtgtcctccagttttgttctggacccagaagagctcgagcgtttgatggcattgagcaatgaaataaagaaccccacaattcctctgaaatcggaattagcttatgagatttttgataaggggcgggttcgcttctggctccaggctgagcacttatcaccagatgccagctaccgatttattattaacgacagagaagtctctgacagcgagatacacagaattaaatgtgacaaagctactggcattattgagatggtgatggatcgatttagtattgaaaatgaggggacctacactgtgcagattcatgatgggaaagccaaaagtcagtcttctctagttcttattggagatgcattcaagactgtgctggaagaggctgagtttcaaaggaaagaatttctcaggaaacaaggccctcattttgctgagtacttgcactgggatgtcacggaagaatgtgaagttcgacttgtttgcaaggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaagtaagatttgtgtatttagttactatgatatcctgtgggcagttgagtcccagtcgttttggctgcatgtgggaatctgtatggaagcctgggtgacctaaagaaagagccattcctgggacagaagtgggaatttaagcaatgcagtatatggaggggtgggcattctcctaaaccagaaatgcatttataaacggactgtccagagtcatcggaaccccggatgaatttcggaaatcattattgtgagagttgaagaaagagaaaagaaacacgcaaagcagattaacagtcaaagacaggtttattttggagaataaacctgagtggggcttttggccgatttcggtcaggagcgctttcttttacagactaagggtatttaagggttctggctcaggctaggaaggtttctgtgtggaggagagttttattgtgaggttggaatacctctggttggaggggagcttatctcagggttggaatgtttttgattggagggcaggttatgccagggttggtatgtttctggtcggaggtgtcatttgtggtttatggccatgctgacattagcccttaagctgatgtttttgggctggacttaggcggtttctaatcaaggaagacttaaaatggcgatgctagtccaagatggcggtgctgctgctctgccagtcatcatcagggcagcacatcacacacagcaactttttaaggacaattcggggttttcaaatgcaccatcgagtcttcgcacatccgaagctgaccgcagtccttggcccatgctagcttatttaatgaacatttgttgactgggtgcagggatgagcaagatagatcagaaactgacaaattccgaaaatatctcaagtctccagtgcaatctagtgaatttgtgaaaaaaaaaaaaatctcttcaacctgtgagctggaatgctaaacttttctgtgggttttagcatctggataatagggcattttccacctcaaaatgggcagtgggaaccatcaggaaaaatcagtgatatccatcctggggtcctgtgacccgaacatgttcttctaagagaatgcaaacgtatctccttcttcttttgcttcatcgctagtgagcctctcagctgtgcattttgttggaagcattttctcatactctcttttcattctctcctttctgtcccctttaacttttagagctgctgcttttgcagagaagaatcgtggcaggttgatcggcggcttgcctgacgtggtgaccatcatggaagggaagttttccagctttattctttttgtttgagaagcagcaatgttccttccagctttctgcaccctgggtagaagccggaagctccccaagcagcagactcgcatgcccataggtgatgtctgtgacgcgccacatccaaacgaagagatatcgttggaagacttgaatctagctggaaggccaatgttcttttcaatgtaatgccaaagaaaattcacacttgtttgttctgtagaaaaaagtgacataatattatttttatttttaaatttacttatagtcatatgtgcatgcctgctcaaaaatgctcacccatcatttgcataagtaaatcagtttgtatttaatgttacagtttaagactcatgtttcagaaatacaatttttattaactga

SEQ ID NO: 4363 - DNA, 1767 bp, Homo sapiens
agagatggtaactccagcagggcagtttcatatccaccgagagaaggagatttaggatacacatccagcagttaaaaccagcaggggctggcaagtagctgggtgtgggtgagagggaagtgtactggaggaccgagtgggtgtgatatttcttgagatcagcactgtacggggagggccaagttttagggttttgagaatacattcaatttcacaaagatttagttatatccgtggaatggtcagtaaggcataaccggctcacgacaggacatgtgaacctggcagcaatgggaaagtcatctggagcatgtggattcatgagatatcgtgtgtggattcatgaggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 4364 - DNA, 1617 bp, Homo sapiens
gctgccaaaggacagcctttagagacaggaacatcacaaacaattggggcattctggaaaattcagattgtcagaggagaagaggagaccagctccaggattattaagcagaaaccctcagagagttcagagggaaagcaagtgacttggtggcctctggcagggagggactttggagtgaagcgctgcgtggccgggttgcaaacaccaagaaagaaaccgttttcaaatggctcaaggatgatgttctgtatgaaacggagacactgcctaacctggagaggggaatctgtgagctcctcatcccaaagttgtcaaagaaggaccacggtgaatacaaggcaaccttgaaagatgacagaggccaagatgtgtccatccttgaaatagctggcaaagtgtatgatgatatgattttggcaatgagtagagtctgtgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 4365 - DNA, 1330 bp, Homo sapiens
ggcagtacctcggcgtgacgcggtgacgcagccgcaggcaggcagtacctcggcgtgacgccatgacgcagccggagagagcttcacgcacaccatctcttcgttcttcctgaactctgtcacggagggggcctttgtttatttatttttgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagcttttgatgaagcatttgcagaattccagcaattcaaagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 4366 - DNA, 1293 bp, Homo sapiens
ggcagtacctcggcgtgacgcggtgacgcagccgcaggcaggcagtacctcggcgtgacgccatgacgcagccggagagagcttcacgcacaccatctcttcgttcttcctgaactctgtcacggagggggcctttgtttatttatttttgggaaatctgcttcgccactgaaggtactctgcaccccagaaggaatacgacttcagtgtttcatgaagtattttacagacgaaatgaaagtgaactggtgtcacaaagatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaagagctgctgcttttgcagagaagaatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 4367 - DNA, 1352 bp, Homo sapiens
ggcacccgccatcatgcccggctaatttttgtatttttagtagagacagggtttcatcatgttggccaggctggtctctaactcctgacctcagatgatctgcccgccttggcctcccaaagtgttgggattacaggcgtgagccactgcgcctggccaggaccccgtcactttctgcccaactcagggacacacgcggctctccaggccttccgtcctcggtgaattcttcacccttcaagcccagttcccatctcacatttcctctggagtgtttctcccccaaccccttcacagagtctgttatctcctcatctaccttcccttggctttggtttatccctcaactgtaaacatataaatctttttctttgatgctcgctctctcctgagcataaactcctcaccacattcaccttggtacccactgctgcttacatggctcctgctccgtgggaacgtcccgcagatgttttcctaaccaaggtgctttcccgttgcagatcgtggcaggttgatcggcggcttgcctgacgtggtgaccatcatggaagggaagaccttgaatctgacctgcacggtgtttggaaaccctgaccccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 4368 - DNA, 2481 bp, Homo sapiens
ggccgaggggaggcggaaatagccgaaaggagctgagcaggagcgaggaggcgacgggggagagccagaaagagctgaagacagggtctctctgtcgcgcagactagagtgcagtggtgtgatcacaactcacttcagccttgacttcttgggctcaggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 4369 - DNA, 2652 bp, Homo sapiens
gaaggaggagaaactgagacggtccggaaagagccgaaagcggtgtccgggtgggtggcaggaggtggaaacagccgaaagaaaagcagccaggttcctgggatggctctagggagggttatttacactgtgagtgaggaggcattcacagagaagttcctccagagtgtggaagaagcactaccatttggcaccaacgcctggagaacaaaggaggagaccattggccaaagagaggcatttccattttgttggaacctgctgaccaccaacccatagcattttttccctttcttccttgctaatccaatcgcagattcattgaggaggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 4370 - DNA, 2614 bp, Homo sapiens
cgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaaggaaactgaaggtctgaccatctttggggagttgtgaagtcttgacagaggaggggagatctgagctgtatttctcggaacagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggtactgcttctccgagatggccccagtgtgtgcggtggttggagggattttggcacaggaaattgtgaaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 4371 - DNA, 1992 bp, Homo sapiens
cgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggctgcgggcctctcgggtgcttcttgtcggcttgaaaggacttggggctgaaattgccaagaatctcatcttggcaggagtgaaaggactgaccatgctggatcacgaacaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtgtgtctgacttgctgctccagggatgtcatagttaaagttgaccagatctgtcacaaaaatagcatcaagttctttacaggagatgtttttggctaccatggatacacatttgccaatctaggagagcatgagtttgtagaggagaaaactaaagttgccaaagttagccaaggagtagaagatgggcccgacaccaagagagcaaaacttgattcttctgagacaacgatggtcaaaaagaaggtggtcttctgccctgttaaagaagccctggaggtggactggagcagtgagaaagcaaaggctgctctgaagcgcacgacctccgactactttctccttcaagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagcagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgt

SEQ ID NO: 4372 - DNA, 2209 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4373 - DNA, 2419 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgtacatttttctgaaaatacaactgtgaccctta

SEQ ID NO: 4374 - DNA, 3240 bp, Homo sapiens
ccgaaagctaggagacagtcagggatctctaagttcccagtgagtaggaggcagaggtgaggtgtagaactcgtttttgcatgtctctcgcctctagacgcacccttccctcatcccatgccctcccacctccgcccctacattaaaggtagcattggatcccggggccgttcagtgaagctagcaggtgtccgcaggaactcccttccccctgccaggctagaaaccttacaaggctgtctagaaatagcagtgatttgtaaggagagacccggctccagcttggtgactctgggctgactgcctgcctagaggtcctctcggatttttgccctttggagtggtgtcaaaactagacgtgatactttggggatgcagcctgtgatatttcctccagcgaatgcagtgcagggttggattaacaaggtggaaagaattcgagggttccaccaagtagctattaactctagggctgcaggcctcaggccttctgcagctatttctacactccctgtactgaaactatttcttcatactgggcctgacaggcctttgcaacaaggatcacggccgaagccacaccgtgcgcctccctcccggttggttaacaggccctggtttctagtattgcgatttaaagtctggcgctggctgcgcgccagacctgggaggctgccagctaggcttcacgttgctggcgtctgcttcggggcattcattaggtctgaagtctgaatcccagctccctccctctcacccactgagctgcatagctccagattgcctctgcttacgggcggggcttctcagccttctgccttctggcccgatgcccgcttcccaacggccggaggccgctagactaatcggcttcgccctgcgcgctgtaatgcgcatgcgcacgcgcacaagttcctgggcccgcccatcttccggacttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4375 - DNA, 2459 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4376 - DNA, 2590 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccggtacggtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggaggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4377 - DNA, 2340 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccggagccggagtagctcagagtgatcttgtctgaggaaaggccagccccacttggggttaataaaccgcgatgggtgaaccctcaggaggctatacttacacccaaacgtcgatattccttttccacgctaagattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4378 - DNA, 2214 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccggtacgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4379 - DNA, 1932 bp, Homo sapiens
ttggcctcccaaagtgctgggattacaagcgtgagccaccgtgcctggcctggccaggctgtcttgaactcctgacctcaagtgatgtgcccgcctcggcctcccaaagtgttgggattacagatgacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4380 - DNA, 3462 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaagtgctttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgttaagtgtaaagctgtctctgcttaaaaacaagtccccctaccaccaccaccacacacacacacacacacacgaaattgcctgttcctgggctgataggacaccagttaagtagaaacaggagtatggaagagtgtgaacgttgagcttggggatcaaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4381 - DNA, 2091 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4382 - DNA, 2213 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaaggtagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4383 - DNA, 2035 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4384 - DNA, 1820 bp, Homo sapiens
cagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4385 - DNA, 2085 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4386 - DNA, 1963 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4387 - DNA, 1940 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggca

SEQ ID NO: 4388 - DNA, 1320 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaa

SEQ ID NO: 4389 - DNA, 2573 bp, Homo sapiens
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaaggttgatttcaacaagtttatattataatccatgcttgacttaaattctttttccagatggtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaagtgctttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgttaagtgtaaagctgtctctgcttaaaaacaagtccccctaccaccaccaccacacacacacacacacacacgaaattgcctgttcctgggctgataggacaccagttaagtagaaacaggagtatggaagagtgtgaacgttgagcttggggatcaaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagaggtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaa

SEQ ID NO: 4390 - DNA, 836 bp, Homo sapiens
taccatgcttctggcttcctccctgaaggagccttcacatgaactactgggctctgctacatgttaacctagaaaacctcccgagccaaatttcaaacgatacattttaacatgtgaaagaagacaccagctcataagatgtggaacaagaagaaagggacagtgccatgaaatctcaaagattctcaaagaatgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaatctaaaatgaaga

SEQ ID NO: 4391 - DNA, 915 bp, Homo sapiens
ctgacgtttctataaagtaggtcataagaaccttcattccagaagtaccctcaaagacagagacaccaagaagaatcggaacatacaggctttggaaatgtggggctatggagcagcaaggagacacacaataaattttacagagaaacctgtacctctttgcagtcaaataaatcgactgacagaccctgaataaacacagcttaggttttcttagattgctcttatcctggctatccaagaatgttgcaacacctttaaattttaagattaagttgtcattgtcagttcttataacagattttcttactcttaagtttatgggagaggaggagaatataggataatgttaatttctctgccacacagctctgctttcttaataattcagactctctccatccagggaaaaaatgaatacctaatgtgagtatatggaatcctgacccagctttcagattgagagagtctatgaatcatcacatttgatgtttatgattcaaaatgtaggattgccttaaactaaggcaattaggaagatagtttttcagagacgttagtctttgttaagatttctaggtccccataagagcacttagtcagataattgctaaagcacatatgtggctctaggaactaaggaaaaagtaaatgccataggaagactattttttaaattacctcattcatcagtctattgtaagagacagcaaatttgaaactaaaggtcacaggctgctttagatgcatggacttaaaaattagagaaagtcatcaataaaacttagttcttattcattatagtcatttcatttaggaaatttccaaaaggtgaatggaatttttaagcccatgaaagatgaatttttgtcaccttggcctcagagtggctcagggtcagagaaggtagagaga

SEQ ID NO: 4392 - DNA, 3056 bp, Homo sapiens
cacaaggtctgatagttttataagggacttttctcccttttgctcaatacttctccttgctgctgccatgtgaagaaggatgtgtttgcttctccttctgccatgattgtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggtgagtacaaacttgagtttcttttaaactatatattttaagttagttatcttcaagtgtactgataatatgaatctcaccccgagaaaagcaaactatttactttttccaaaaacagttatctctttcttattctcccttttatatatttagcattaaatattattttttagaagtcacttgtatgataaaagcctatattttttacagcaaaatagtcgatagcttggatttttataaagtacacacaaaatacctttaattaaaaaaattattagtggttgcaatgattgtgttttttaaagccctcagttatgcaaatataaattgtatagattatataaccaaaaatatatttttacttatggatatgaaagccagtttcagtaaagcttcatttcctcagtgaccataagtaggtgatgtgatacagagaaatagattcaacacagatttcctatctcactcagcaactgaaaccttagcatgtctcaagcatcatgctaatattccctgtcttacttgtgcttatgactaagaaaacatcatgagcatgtataggatggcttcttataacttggggcaaatgccagaagatgaggtgtaaataaagtgcaacaggagtgaagcagagatacatattttttattaaaaggggccaagaaaggatccatgaaaagaatagaatgccagccgggtgcagtggctcactcctgtaatcccagcactttgggaggccgatgcaggtggatcacctgagaccagcctggccaacatggtgaaaccccatggtggcgggcgcctataataccagctactcaggaggctgaggcagaagaatcgcttcaatctgggaggcagaggttgcagtgagctgagattgtgccactgcactccaacctgggtgacaagagtgagactccatcttaaaaaaaaggaaaaaaaaagaatagaatgccatttaaatagagttctgaattttggcaatatcaaaagagcatgccaggttaaataaaggtgtggaatgaacaaagcaaataaaagggattccacgagtgactttagtttttctgagattgacttgatattaaagactttgactcaggctcaaatgactgtgtaaatttccattatattctactgcataaattcccttttctgtaatgcaaaccttcttcttgggctgttttaaaccattttggaaaattctcagagtttagcaagtattgtggaaataggacctctggatgagaggtctaatatcctgaagttttagacccaaaacattaggtattctactttgtaataaatctgtttccataattaagacttgtaaaaagaatttgaagccacctgttagttttctcatgacccatgttcttgacattaagctcaaacatcatatttccatccaatgggaggagaaagcaagagaacaacagctttgagacttgggaaatttccaagtgccgctcaacatttacagtgaaacattagaaaaatattagtagagggctggaacaccctatctgcttagcctctgaaacctccgagtttctgcttattctttctatttgttcaaaactatgtaaatatgggaggcacatttgtatgctagaaaacatgacctctcttcctatatttctcagataagaaaatttaggtctagagacaaaatgttgctttctcaaatacaacatatttcctaatgtatgacattgcctttttcactgttgattaaaagtaccaaacttattacctagtaactaaagccagacgctgaccctagtttgagacaagtagataataccaaacaagggcttgcaaatcagtctttttggtgattatgtgcttggcaaatatattcaataaacactttttctattccttctacgtcttcatagggaatctgtaccggcaaattcttttccataaacctgcatctccaatagaaccttctataatgatggaaatgttctatgtttatgctgtctaatacatagccactagccacaaaacagtagccttaatgtggctaacactaacttaaatgtggctagtaaaactgatcagctgaatatttaatattatctaaactaatttacatttacatagctatatgtggatagtgaatatatgaaactagagtgaacagcatagcaactcttgtttattctgtttaggtgtgtgtgcttatgtatgctaactgatttggaaatcagtattaatgagcagttaatgattgtgggacaagaaagcattaaaaaatcttaaagagtttggctgggcatggtggctcatgcctgtaatcccagcactttggaagtcccaggcaggtggatcacttttgttaggagtttgagaccagcctggccaacatggtaaaaccccgtctctactaaaaatacaaatattagccaggcatggtggcattcacctgtaatcccagctacttgggaggctgaggcaggagaatcacttgaacccgggaggtggaggctgcagtgagccaaggtcacaccactgcactccagcctgggcaacagagtgagactctgtctta

SEQ ID NO: 4393 - DNA, 2401 bp, Homo sapiens
cacaaggtctgatagttttataagggacttttctcccttttgctcaatacttctccttgctgctgccatgtgaagaaggatgtgtttgcttctccttctgccatgattgtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggggccaagaaaggatccatgaaaagaatagaatgccagccgggtgcagtggctcactcctgtaatcccagcactttgggaggccgatgcaggtggatcacctgagaccagcctggccaacatggtgaaaccccatggtggcgggcgcctataataccagctactcaggaggctgaggcagaagaatcgcttcaatctgggaggcagaggttgcagtgagctgagattgtgccactgcactccaacctgggtgacaagagtgagactccatcttaaaaaaaaggaaaaaaaaagaatagaatgccatttaaatagagttctgaattttggcaatatcaaaagagcatgccaggttaaataaaggtgtggaatgaacaaagcaaataaaagggattccacgagtgactttagtttttctgagattgacttgatattaaagactttgactcaggctcaaatgactgtgtaaatttccattatattctactgcataaattcccttttctgtaatgcaaaccttcttcttgggctgttttaaaccattttggaaaattctcagagtttagcaagtattgtggaaataggacctctggatgagaggtctaatatcctgaagttttagacccaaaacattaggtattctactttgtaataaatctgtttccataattaagacttgtaaaaagaatttgaagccacctgttagttttctcatgacccatgttcttgacattaagctcaaacatcatatttccatccaatgggaggagaaagcaagagaacaacagctttgagacttgggaaatttccaagtgccgctcaacatttacagtgaaacattagaaaaatattagtagagggctggaacaccctatctgcttagcctctgaaacctccgagtttctgcttattctttctatttgttcaaaactatgtaaatatgggaggcacatttgtatgctagaaaacatgacctctcttcctatatttctcagataagaaaatttaggtctagagacaaaatgttgctttctcaaatacaacatatttcctaatgtatgacattgcctttttcactgttgattaaaagtaccaaacttattacctagtaactaaagccagacgctgaccctagtttgagacaagtagataataccaaacaagggcttgcaaatcagtctttttggtgattatgtgcttggcaaatatattcaataaacactttttctattccttctacgtcttcatagggaatctgtaccggcaaattcttttccataaacctgcatctccaatagaaccttctataatgatggaaatgttctatgtttatgctgtctaatacatagccactagccacaaaacagtagccttaatgtggctaacactaacttaaatgtggctagtaaaactgatcagctgaatatttaatattatctaaactaatttacatttacatagctatatgtggatagtgaatatatgaaactagagtgaacagcatagcaactcttgtttattctgtttaggtgtgtgtgcttatgtatgctaactgatttggaaatcagtattaatgagcagttaatgattgtgggacaagaaagcattaaaaaatcttaaagagtttggctgggcatggtggctcatgcctgtaatcccagcactttggaagtcccaggcaggtggatcacttttgttaggagtttgagaccagcctggccaacatggtaaaaccccgtctctactaaaaatacaaatattagccaggcatggtggcattcacctgtaatcccagctacttgggaggctgaggcaggagaatcacttgaacccgggaggtggaggctgcagtgagccaaggtcacaccactgcactccagcctgggcaacagagtgagactctgtctta

SEQ ID NO: 4394 - DNA, 1640 bp, Homo sapiens
tttattttcaattcctggtatttcttattagtatctggaaatacaaaaattgcattttgtgtatttacattacacattttgaatgttttgaaagaaaatattctgcttgaatagatggtgcacatatacctccaactgcatcttgacaatgttgacagacaactctgaacccgcagagccaagatcagtttcctttttatcactggaaatggttaacattttcaacttcacctctcatgtagtgaaggatcctgtggagagccaaatcagcactttgctaagaagaggaagaatattgtttgttttatttgctgaatatttatggcaacagtcagtgttccctttccccctcctcatgcatgttaattaatacaaatagatgcctgtgatgagcacctgctcttcagtttttagactcaactagattctaaaagccagtgggcccccaacaacatcaagttctgactatcccgggggaaattctccaagctcatagatgcctcactaattttcattacatttagatacaaagaactacctctttgctcagatcacctcaaagattgatgatattaaaattaattttcaggaatgtttccttatttgattgctatcatattagttccctttcccttccatgaacttatccacagttatcatttcctatatgttgtcagcaaaacctctgctattttctgggggaatagagattagctattttgactacctgtaaattcaacaaatgtgagttagacccatagtccatatgatgcaattgttggaaatagctctttgggaactgatagtgagttggcaaaagaactctattttttcaacaatacttacaaaagggaatttaaatgtaattgaaaaagctaactttgcatcagaagacctggttactgcttatgataactgtttcacagctagttataaaaactctccatactttcatctgtaaactgagataaaaattatacttcactaattgtgagattaaagatctagtaactggttttgagaatgtttgtgagtattcaaaagataatttgctcagtgcctgattcatttccagcagtaagtgcataatttctgttttcaaggaaatagatcaacttcctaaaacatcaaatcgagatactttggtcataatcaaagttttactcaaactttttaaggttttgccaaggaaggggtacaggaaaatcagtcagatacttttggaagattagagaaatcagaaagggtggggaatgaaagagcctagtaaagaagtcacagtctgcaatgaaagcagagaattctgatgaagaatagatctgacttctttcatttaggacccaacttaccatatctgatttatttctaggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatccaaaaaag

SEQ ID NO: 4395 - DNA, 2575 bp, Homo sapiens
ccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgggcaagttatttaacacccctgagcttctttcttcatctgcaaaatggaacccctccccttcctttgaattgctgagcccattacgcgaggtaacgtgtacgacgctctctgcacagcgccaggtcccaatcccggtgttccggctcagcacggcccacgcgtttcccagtttccattgcgtttctctttctgaaatcttcttgcccctctcctgggaagctccccgattcttcttggcccttccttcccttccacagtccctctccaccctaagcccagcgggcccgcctcccccctccttcccggcaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtacctggggtatcaaacaggtacacgcggcatctggggacgcagccaaactcccccgccactccctggccgcccgtctttccagcgcgcacgattcagtgctgggttcccagaactcattttatcagacatttgcatacgcatatatcccttagccttaacttcacaatttctccaccaacgaaaaatcctgtcactcggcttccaaagaaatagcctaatagactaatagctgtaatcagtcccaaatagctcttttggcacctctagtctagcctccgaaaaagccttcaaaatttcccaagctttttttttttagttggacagtagttagatcaactgcgctggaagtacgctctaggtcacttacgtggaagcagtggagaggcagagccccggctgtctctctggaagggatggggaaagtccgggcgtcatactggggtgggcctggggcccgggaagccgcaaagcggggttgagtgcgccctgtgttgcaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaaaaaaa

SEQ ID NO: 4396 - DNA, 3265 bp, Homo sapiens
ctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacggtgagcgcggccagggcaggacggggacgggcggagcagggacggccaccccaggagatgccaggggagaagggccaggggcgaggacctgggtcgagggcggggcctgaacgttacccccgggctagaggcggggcctggggccgggggccgggcctcgaaacctccccaagtcgggtcggggctccgcgggaccggccggctccatcccacagaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttc

SEQ ID NO: 4397 - DNA, 5730 bp, Homo sapiens
ctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactcccgacccgggtggatttctccctggctggggcactcaatgctggcttcaaggagacccgggccagtgagcgggcagagatgatggagctcaatgaccgctttgccagctacatcgagaaggttcgcttcctggaacagcaaaacaaggcgctggctgctgagctgaaccagctgcgggccaaggagcccaccaagctggcagacgtctaccaggctgagctgcgagagctgcggctgcggctcgatcaactcaccgccaacagcgcccggctggaggttgagagggacaatctggcacaggacctggccactgtgaggcagaagctccaggatgaaaccaacctgaggctggaagccgagaacaacctggctgcctatagacaggaagcagatgaagccaccctggcccgtctggatctggagaggaagattgagtcgctggaggaggagatccggttcttgaggaagatccacgaggaggaggttcgggaactccaggagcagctggcccgacagcaggtccatgtggagcttgacgtggccaagccagacctcaccgcagccctgaaagagatccgcacgcagtatgaggcaatggcgtccagcaacatgcatgaagccgaagagtggtaccgctccaagtttgcagacctgacagacgctgctgcccgcaacgcggagctgctccgccaggccaagcacgaagccaacgactaccggcgccagttgcagtccttgacctgcgacctggagtctctgcgcggcacggtgagcgcggccagggcaggacggggacgggcggagcagggacggccaccccaggagatgccaggggagaagggccaggggcgaggacctgggtcgagggcggggcctgaacgttacccccgggctagaggcggggcctggggccgggggccgggcctcgaaacctccccaagtcgggtcggggctccgcgggaccggccggctccatcccacagaacgagtccctggagaggcagatgcgcgagcaggaggagcggcacgtgcgggaggcggccagttatcaggaggcgctggcgcggctggaggaagaggggcagagcctcaaggacgagatggcccgccacttgcaggagtaccaggacctgctcaatgtcaagctggccctggacatcgagatcgccacctacaggaagctgctagagggcgaggagaaccggatcaccattcccgtgcagaccttctccaacctgcagattcgaggtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacagggggcaaaagcaccaaagacggggaaaatcacaaggtcacaagatatctcaaaagcctcacaatacgagttataccaatacaggctcaccagattgtaaatggaacgccgccggctcgcggttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggagctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattagtgaatgtgacgtgttatatttttctctctcgggcggggcgggggggggggagagctaaattactttttacttgcattggccctgaaatgattcttagctaaggaacaaaattcctcttcttctggactagaatatttaggaccactagatatgcatgtctcaggacttaattcagcatcagaaaggctaaccaggctgactagtagaggtaatactgccaaatcctagatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctggaatgcagtagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactctggcagcagcactattgggatttgggggctctccagcccgtttggaagagcctaggctctctctgctcggttgcataggttctcatactcatgatggggaggggggtgcgatggggaagccgggcatgggagaggatggctcatgccctgaaagtccatgagaggcctcctctccccacatctgcagaaaccagcctggacaccaagtctgtgtcagaaggccacctcaagaggaacatcgtggtgaagaccgtggagatgcgggatggagaggtcattaaggagtccaagcaggagcacaaggatgtgatgtgaggcaggacccacctggtggcctctgccccgtctcatgaggggcccgagcagaagcaggatagttgctccgcctctgctggcacatttccccagacctgagctccccaccaccccagctgctcccctccctcctctgtccctaggtcagcttgctgccctaggctccgtcagtatcaggcctgccagacggcacccacccagcacccagcaactccaactaacaagaaactcacccccaaggggcagtctggaggggcatggccagcagcttgcgttagaatgaggaggaaggagagaaggggaggagggcggggggcacctactacatcgccctccacatccctgattcctgttgttatggaaactgttgccagagatggaggttctctcggagtatctgggaactgtgcctttgagtttcctcaggctgctggaggaaaactgagactcagacaggaaagggaaggccccacagacaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgagctgccatccagggatgccatctgtgggcacgctgtgggcaggtgggagcttgattctcagcacttgggggatctgttgtgtacgtggagagggatgaggtgctgggagggatagaggggggctgcctggcccccagctgtgggtacagagaggtcaagcccaggaggactgccccgtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcagggcatgactttgtcccatttctaaaggcctcttccttgctgtgtcataccaggccgccccagcctctgagcccctgggactgctgcttcttaaccccagtaagccactgccacacgtctgaccctctccaccccatagtgaccggctgcttttccctaagccaagggcctcttgcggtcccttcttactcacacacaaaatgtacccagtattctaggtagtgccctattttacaattgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagatgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgcccttc

SEQ ID NO: 4398 - DNA, 2829 bp, Homo sapiens
ggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagaaaaggagt

SEQ ID NO: 4399 - DNA, 2406 bp, Homo sapiens
ggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgaga

SEQ ID NO: 4400 - DNA, 2599 bp, Homo sapiens
ggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagaaaaggagt

SEQ ID NO: 4401 - DNA, 2906 bp, Homo sapiens
agatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacagtattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagaaaaggagt

SEQ ID NO: 4402 - DNA, 2995 bp, Homo sapiens
agatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacagtattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagaaaaggagt

SEQ ID NO: 4403 - DNA, 3162 bp, Homo sapiens
ggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggagcatatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgggtaggaggtgtgcaatctttggggggaacaggtgcacttcgaattggagctgatttcttagcgcgttggtacaatggaacaaacaacaagaacacacctgtctatgtgtcctcaccaacctgggagaatcacaatgctgtgttttccgctgctggttttaaagacattcggtcctatcgctactgggatgcagagaagagaggattggacctccagggcttcctgaatgatctggagaatgctcctgagttctccattgttgtcctccacgcctgtgcacacaacccaactgggattgacccaactccggagcagtggaagcagattgcttctgtcatgaagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccgtaagtggcccccaccacctccagcccatgcgtgcatgtagacacacaacattcctttcagtcgctcgccttgagctgagctcactttcacagcctttgcctaattgggcagccattgctttggaccaggacaagttaggttttcttagggtgtcccaccatctcataaactctctgggtctcagaagagtattgtggtctgccctgctgacccacagccaagatatttccgtgtttgtgggctgggaagtggctcagagccagctgggaggtaacaggattggtagctgggagccttaatttatgaaaggttcttataaatgctcaggtacattttgggtttgccttaatcctgaatataatgattattcagggaactgatttcttgacaggtctttcttatttctaggtattatcctcaaaaagagattacaaagttatctctgcatttcataaacaagaacctagattgggctgggcacagtggctcacacctgtaatcccaaagtacttggattacaggcatgagccactgtgcctggccagcatgcaaatttattaacttgcacaggtgtcttacaaaatagaactcaaataaatggccagatgattgatgcttttataccatcttggggttatagaaagaatgggagcttggagcttgccagaacagattatggcaggcagagaagagaaggcctggttagcaaaggtggtcttgttatattatgtagataagacaggtagcagccctcggagaaaatagcggtaaaggtctatttcttttagacctttaaaggcatcacactctcagttaatctcccctagatctggacaagggagggcctcagagaaagcctagctgcagccatgcagattttctctacagatacagatctctcccacaaaagacagctttgcagggctacttctgtatgtaggccctctcaacagccatctcaaaatatgtcaaagtatattttggggtgaactattttggtttccttcaaggagcactgagtccagggtccagatttttcacttccttagagaggcactgtagcatcac

SEQ ID NO: 4404 - DNA, 3239 bp, Homo sapiens
agatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacagtattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacagtgagtgctctcctgaggagttacagccccacctcctcgcatcactccctgcttcagcagccacagctgattctggtccctctctttagatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggacaggtaatgtgaagacaatggctgaccggattctgaccatgagatctgaactcagggcacgactagaagccctcaaaacccctgggacctggaaccacatcactgatcaaattggcatgttcagcttcactgggttgaaccgtaagtggcccccaccacctccagcccatgcgtgcatgtagacacacaacattcctttcagtcgctcgccttgagctgagctcactttcacagcctttgcctaattgggcagccattgctttggaccaggacaagttaggttttcttagggtgtcccaccatctcataaactctctgggtctcagaagagtattgtggtctgccctgctgacccacagccaagatatttccgtgtttgtgggctgggaagtggctcagagccagctgggaggtaacaggattggtagctgggagccttaatttatgaaaggttcttataaatgctcaggtacattttgggtttgccttaatcctgaatataatgattattcagggaactgatttcttgacaggtctttcttatttctaggtattatcctcaaaaagagattacaaagttatctctgcatttcataaacaagaacctagattgggctgggcacagtggctcacacctgtaatcccaaagtacttggattacaggcatgagccactgtgcctggccagcatgcaaatttattaacttgcacaggtgtcttacaaaatagaactcaaataaatggccagatgattgatgcttttataccatcttggggttatagaaagaatgggagcttggagcttgccagaacagattatggcaggcagagaagagaaggcctggttagcaaaggtggtcttgttatattatgtagataagacaggtagcagccctcggagaaaatagcggtaaaggtctatttcttttagacctttaaaggcatcacactctcagttaatctcccctagatctggacaagggagggcctcagagaaagcctagctgcagccatgcagattttctctacagatacagatctctcccacaaaagacagctttgcagggctacttctgtatgtaggccctctcaacagccatctcaaaatatgtcaaagtatattttggggtgaactattttggtttccttcaaggagcactgagtccagggtccagatttttcacttccttagagaggcactgtagcatcac

SEQ ID NO: 4405 - DNA, 1977 bp, Homo sapiens
agatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacagtattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcagcaccggtttctgttccccttctttgactcagcctatcagggcttcgcatctggaaacctggagagagatgcctgggccattcgctattttgtgtctgaaggcttcgagttcttctgtgcccagtccttctccaagaacttcgggctctacaatgagagagtcgggaatctgactgtggttggaaaagaacctgagagcatcctgcaagtcctttcccagatggagaagatcgtgcggattacttggtccaatccccccgcccagggagcacgaattgtggccagcaccctctctaaccctgagctctttgaggaatggtaaggggctcccagtctggtgggccggggggtggggag

SEQ ID NO: 4406 - DNA, 5805 bp, Homo sapiens
cgcccggccagggtggaggcgggtgcggcgacccggccggctcctagaggcgcagcgggagaggaagtgtcagtttgtgaacctgcagcggccccggcctggcccctggccgggcgggcggggacctcgcagcgccgggcgagccaggtggcagggagaggacagggattcagaccgcatcccctgcccgggagcctgtgcgctctgcgctggagaaaaaggagatgggagtgggggtggagaaggtcgtggccacgccaccatctggggagccgagacccctgcagtgcctggctcgccccagggccccgcacatacttagcttcacacactccctggcacaatgccgtagacatcatcctgcccagtctcacaggagtacacacacgcaccacacagaaacaggcactggactctctccctgtgaacagatagtcacaacaccaggtgcccagcgccatggccacaaggaggagacccgagtaggcccgcggggaaagagagaggctgtgtgtggctgtagtggagagcatgtggagggacttggagccagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 4407 - DNA, 5633 bp, Homo sapiens
tccatccagagcacatggactgtgtttgcttaaggaataaaacctcagcctcctgagacagggagtggttcaggcccgctgggtaggggactttgttctgtgtgggttgagagatccattctctttaaaaggtagtgtggtatgggccatggctctgcctttggcccatcagcctcttctccttgccacacctgtttccctatctgtaagatgtgaataataataatgtctccctcataggatggtcacgaggaatcagtgagataataaccaagtctggcttatagcacagggtacagaaatggtggtttccttccttcccctgatgggctttctgaagcagggaagcaagaagcaaaaaccctgttctttctctcccagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 4408 - DNA, 5454 bp, Homo sapiens
gctctccaggattgggagattttgtgccatggggctgctcccaggctttccttccaggttcaggcaggtactcagcagtgctaggttctgctgaggcgccaggatccagaatggggcagtgaggcaggtgagagcagggggatcaaggggcagaaggaagtgaggaaggaggtgaaaggactcctggatctctgctgagaagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 4409 - DNA, 5471 bp, Homo sapiens
gctctccaggattgggagattttgtgccatggggctgctcccaggctttccttccaggttcaggcaggtactcagcagtgctaggttctgctgaggcgccaggatccagaatggggcagtgaggcaggtgagagcagggggatcaaggggcagaaggaagtgaggaaggaggtgaaaggactcctggatctctgctgagaagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagaggcagcagctcttagcaaaggtggctctgctggaatttcgcaggagatattatcccatattaggtgtgcttcctgaatgaggagaaggacatacaggcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 4410 - DNA, 5817 bp, Homo sapiens
taaagttttaagaaaataacaaccatttaacaaaacaagttaaataaggcgggagaggcagcatgatgtgtcaaaagaacaaagggtttgatgtcaaacagccatgggtttaatccccccctcacctacttactagctaagcaagggacttaacctttcagagcctcaatttccccatctttcgaatggtaatgatgataggcatctcagagtggttggggagattcagtgaggtggcatgtggggcccagcgctaggcctagcagacattagaggctgggcatctggaatgtgagtataaaacttccattcctgtgagctggacccgaccctcgaggccctctctttcagccggtgttccaggagaggagcccaagtgcaacatctgcctagggaagacatcagggccgctgaatgagatcctcatctgcgggaagtgtggcctgggtgagtggagcgagcagggccctgagaaggccccgacctataggtccccacgcactggcccctgacgggtactgctgcagcctgttggggcctcagctggcttcctgtttctcttggcactgcagggtgaaagggggccagttgctgtaagtgagggcttgggaagagatcctggggaaagctgggagggtatgatggtgtatgtaatttggggcccagctagatggagaggatgggtgggaaagatggggctcaggcactgaagtcagaccttcctgtgtcccccccaaccccacaactggccaatgctgtcatttagttcccagcctggacactgacttggccatcttggtgggcaccagcagccaggctcccggcagctggcaggcagagctcctaggacttccctcagccctcccagccctgcctcctttgggccaactggccttgggccacgatgtccttgtgggcgctcaccgccccctcctctgccgtaggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 4411 - DNA, 5593 bp, Homo sapiens
caccttcctgggagcatgttcaagaataggaggcaacgttcctgcctggccatatattcaacaaacgtcttggaacacctgttacatgccacactctatgaggtcctggggatacagagatgaagagccggtgttccaggagaggagcccaagtgcaacatctgcctagggaagacatcagggccgctgaatgagatcctcatctgcgggaagtgtggcctgggtgagtggagcgagcagggccctgagaaggccccgacctataggtccccacgcactggcccctgacgggtactgctgcagcctgttggggcctcagctggcttcctgtttctcttggcactgcagggtgaaagggggccagttgctgtaagtgagggcttgggaagagatcctggggaaagctgggagggtatgatggtgtatgtaatttggggcccagctagatggagaggatgggtgggaaagatggggctcaggcactgaagtcagaccttcctgtgtcccccccaaccccacaactggccaatgctgtcatttagttcccagcctggacactgacttggccatcttggtgggcaccagcagccaggctcccggcagctggcaggcagagctcctaggacttccctcagccctcccagccctgcctcctttgggccaactggccttgggccacgatgtccttgtgggcgctcaccgccccctcctctgccgtaggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 4412 - DNA, 4127 bp, Homo sapiens
gaggtttttttgacttcttggactttgaagggtggctgggtaggaaacagacaggtgtggtggtgggaagctcagctgtgggaagacgggcctccactgggatgaaggatgcatgttaggggaacctgcgggccaggttggcaggaacttgctgggccgggccaccagcaggctcacggtcttgcccctctcagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 4413 - DNA, 2168 bp, Homo sapiens
ggcgaggccggcgcggcccccgctaattacataagcgggacgtcaataattcgcgggaaaacgcgaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaaggtatcagtgagggacctagcacagaggtctgctctggagacagggagggaaccaagcagaaagccaagccctcagttaaaaggatccctgctgtgcaggtctgtctgaaggggctttttgcagtagagctttcagcataacatccctgttcccagagcaccacagccctcccctcttctccagccctccccaccttgccccatggttatccacactcaccatgctgtttgatgcttgctcatctttgctcgtattgctccctctgcctgagataccctttgccttgccctagcccatctgaaaactcaggaccctgcttcttccaggaaggctttactaaccctccccaggctgtgctggacgccctcctttgtagttccatagcaccccatgcttaagtatgtccaagggaggaactgcatcttccatcattttattttccaaattattaaaggtcatttagtattttcctgaggacacagaggagggctttagagtcagacctgaactccagaccctgcttatcagtactagctatgtagtttta

SEQ ID NO: 4414 - DNA, 1252 bp, Homo sapiens
ggcgaggccggcgcggcccccgctaattacataagcgggacgtcaataattcgcgggaaaacgcgaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatggtgagagggtggggcttagtccaaccaccgctgctcctcccagcttctcccctccctcctccctcctggaacaattccatttccagctactgggtcccaaccctgcccctgtctctcagcctggacccagaaagctgtgaccctggctgagcaggc

SEQ ID NO: 4415 - DNA, 1551 bp, Homo sapiens
ggcgaggccggcgcggcccccgctaattacataagcgggacgtcaataattcgcgggaaaacgcgaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggtgagtggagcgagcagggccctgagaaggccccgacctataggtccccacgcactggcccctgacgggtactgctgcagcctgttggggcctcagctggcttcctgtttctcttggcactgcagggtgaaagggggccagttgctgtaagtgagggcttgggaagagatcctggggaaagctgggagggtatgatggtgtatgtaatttggggcccagctagatggagaggatgggtgggaaagatggggctcaggcactgaagtcagaccttcctgtgtcccccccaaccccacaactggccaatgctgtcatttagttcccagcctggacactgacttggccatcttggtgggcaccagcagccaggctcccggcagctggcaggcagagctcctaggacttccctcagccctcccagccctgcctcctttgggccaactggccttgggccacgatgtccttgtgggcgctcaccgccccctcctctgccgtaggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaatccatgtaaataca

SEQ ID NO: 4416 - DNA, 1414 bp, Homo sapiens
gtctcctggctcagggacctgagagacaggggttaaaaggacgttccagaagcatctggggacagaaccagcctcttccagggaggcctgggagctgggggggtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgagtgggg

SEQ ID NO: 4417 - DNA, 3896 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4418 - DNA, 3281 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4419 - DNA, 4407 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4420 - DNA, 3386 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4421 - DNA, 3946 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4422 - DNA, 3984 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4423 - DNA, 4682 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctc

SEQ ID NO: 4424 - DNA, 2227 bp, Homo sapiens
ccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4425 - DNA, 3776 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4426 - DNA, 3375 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4427 - DNA, 2962 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatgccttgggacctgttaagctgtctcagaaagaattgcttggtccaccagaggcaaagagagcccgaggccctgaggaagaggagattgggagccctgagcccatggcagctccagcctctgcctcccagaaactcaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaata

SEQ ID NO: 4428 - DNA, 2864 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatgccagtgtgcttgcctatggacccacaggagctgggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggactctctgggtggctcagcccacagtatccttattgccaacattgcccctgagagacgcttctacctagacacagtctccgcactcaactttgctgccaggtccaaggaggtgatcaatcggccttttaccaatgagagctgggagccctgagcccatggcagctccagcctctgcctcccagaaactcaggccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaata

SEQ ID NO: 4429 - DNA, 3474 bp, Homo sapiens
tagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatacgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4430 - DNA, 3031 bp, Homo sapiens
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtttgatgccttctatggggagaggagtactcagcaggacatctatgcaggttcagtgcagcccatcctaaggcacttgctggaagggcagaatctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4431 - DNA, 3562 bp, Homo sapiens
tagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatacgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctgctcagccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgaggtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcaggctgccctggagttgggtctggatcacatctccctgatcctttccaacagaggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaattcaggagcaggcagcatccccaaatgccgagatccacatcctgaagaataaaggccggaagagaaaggtgaaagtagctgggggcttaggctacacctggagcccagaagtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggcaaacatcctgggtctcgccgccggccagcgctgtggcgcctcctgaccgtcgtctcctcactccgccttttcaaatttttgtataaccccgtgttgtgtaaatacagtttttgctccg

SEQ ID NO: 4432 - DNA, 203 bp, Artificial Sequence
  Synthetic oligonucleotide
aatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctg

SEQ ID NO: 4433 - DNA, 137 bp, Artificial Sequence
  Synthetic oligonucleotide
gaacgacagattcagctgattcgagagatgctcatgtgtgacacatctggcagcattcaactaagcgaggagcaaaaatcagctctggcttttctcaacagaggccaaccatccagcagcaatgctgggaacaaaag

SEQ ID NO: 4434 - DNA, 131 bp, Artificial Sequence
  Synthetic oligonucleotide
gtactttacaaccttggaacagtgactccaccctgaacagcaggcagctggagccaagaactgagacagacagtgtgggcacgccacagagtaatggagggatgcgcctgcatgactttgtttctaagacg

SEQ ID NO: 4435 - DNA, 165 bp, Artificial Sequence
  Synthetic oligonucleotide
gttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagag

SEQ ID NO: 4436 - DNA, 125 bp, Artificial Sequence
  Synthetic oligonucleotide
aaattcctcagagtgaaaactgtacccctcctcagcaaagtggatgatatccatgctatctgtagccttctaaaagactttcttcgaaacctcaaagaacctcttctgacctttcgccttaacag

SEQ ID NO: 4437 - DNA, 133 bp, Artificial Sequence
  Synthetic oligonucleotide
agtggctcagagtccacatactaaaatggatgttgccaatctggctaaagtctttggccctacaatagtggcccatgctgtgcccaatccagacccagtgacaatgttacaggacatcaagcgtcaacccaag

SEQ ID NO: 4438 - DNA, 136 bp, Artificial Sequence
  Synthetic oligonucleotide
gtggttgagcgcctgctttccttgcctctggagtattggagtcagttcatgatggtggagcaagagaacattgaccccctacatgtcattgaaaactcaaatgccttttcaacaccacagacaccagatattaaag

SEQ ID NO: 4439 - DNA, 138 bp, Artificial Sequence
  Synthetic oligonucleotide
cagtccctggaggaggattgtgtgtccattttacagctggagaagccgagatccagaaaggacccccaagttgtgggcagaataaatctacagcagcttttaactattaaaccaacttagattttggtagtctttcag

SEQ ID NO: 4440 - DNA, 65 bp, Artificial Sequence
  Synthetic oligonucleotide
ctctgtgattggttggtgaaggttttcaaaccggagctgtgggcgcggcgctgctctgccgttgg

SEQ ID NO: 4441 - DNA, 53 bp, Artificial Sequence
  Synthetic oligonucleotide
gtgaggcgcggagcgaagtgaagggtggcccaggtggggccaggctgactgaa

SEQ ID NO: 4442 - DNA, 4 bp, Artificial Sequence
  Synthetic oligonucleotide
aaag

SEQ ID NO: 4443 - DNA, 85 bp, Artificial Sequence
  Synthetic oligonucleotide
atggatactatgatgctgaatgtgcggaatctgtttgagcagcttgtgcgccgggtggagattctcagtgaaggaaatgaagtcc

SEQ ID NO: 4444 - DNA, 70 bp, Artificial Sequence
  Synthetic oligonucleotide
actatcaaccattgatgaatctggttccattttatcagatatcagctttgacaagactgatgaatcactg

SEQ ID NO: 4445 - DNA, 54 bp, Artificial Sequence
  Synthetic oligonucleotide
gattgggactcttctttggtgaagactttcaaactgaagaagagagaaaagagg

SEQ ID NO: 4446 - DNA, 81 bp, Artificial Sequence
  Synthetic oligonucleotide
cgctctactagccgacagtttgttgatggtccccctggacctgtaaagaaaactcgttccattggctctgcagtagaccag

SEQ ID NO: 4447 - DNA, 118 bp, Artificial Sequence
  Synthetic oligonucleotide
gggaatgaatccatagttgcaaaaactacagtgactgttcccaatgatggcgggcccatcgaagctgtgtccactattgagactgtgccatattggaccaggagccgaaggaaaacag

SEQ ID NO: 4448 - DNA, 96 bp, Artificial Sequence
  Synthetic oligonucleotide
ggaatgctggcagactttgtgtcccagacttctccaatgatcccctccattgttgtgcattgtgtaaatgagattgagcaaagaggtctgactgag

SEQ ID NO: 4449 - DNA, 54 bp, Artificial Sequence
  Synthetic oligonucleotide
acaggcctgtataggatctctggctgtgaccgcacagtaaaagagctgaaagag

SEQ ID NO: 4450 - DNA, 20 bp, Artificial Sequence
  Synthetic oligonucleotide
agcctttatggaagcagcag

SEQ ID NO: 4451 - DNA, 106 bp, Artificial Sequence
  Synthetic oligonucleotide
aaatcacagatgaagacaacagcatagctgccatgtaccaagctgttggtgaactgccccaggccaacagggacacattagctttcctcatgattcacttgcagag

SEQ ID NO: 4452 - DNA, 58 bp, Artificial Sequence
  Synthetic oligonucleotide
ctgcacttcttgctgctgccatgtgaaggacatgtttgcttccccttctgccatgatt

SEQ ID NO: 4453 - DNA, 29 bp, Artificial Sequence
  Synthetic oligonucleotide
tggatgagtggggcccagcttggagagat

SEQ ID NO: 4454 - DNA, 2019 bp, Homo sapiens
tatctttgagcatgtggtaaaaggtataaggtgaattggtcagtgtaggggagcaataagaacagcatgctgttctttggatgatgatatatgggcaaaatgttcttgattatctcttctttaaatttcctaatgtttttttcttcaggatcctataactcatctctgatacatataattaaatatttaataagttgtagtccgacatgctcaaatggaaaaattggaaagttacaattttcaggtttaaagtttgtaacattccatttttacccttcaaattctttttatcctctcccttccacagtatagatagtaagacttgttttagtatattagatcttacctcccaattgaaatggaaatgtagcagaggtgttcatagtccaaactattttaaattctgtttttaaaagcaaatttctttcaagctttttcccaaaaatttggaagtcattttaaaaagtattgtggttttattgttttctatcctttttaaatgaatttttttcttagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagccttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaagg

SEQ ID NO: 4455 - DNA, 1743 bp, Homo sapiens
tatctttgagcatgtggtaaaaggtataaggtgaattggtcagtgtaggggagcaataagaacagcatgctgttctttggatgatgatatatgggcaaaatgttcttgattatctcttctttaaatttcctaatgtttttttcttcaggatcctataactcatctctgatacatataattaaatatttaataagttgtagtccgacatgctcaaatggaaaaattggaaagttacaattttcaggtttaaagtttgtaacattccatttttacccttcaaattctttttatcctctcccttccacagtatagatagtaagacttgttttagtatattagatcttacctcccaattgaaatggaaatgtagcagaggtgttcatagtccaaactattttaaattctgtttttaaaagcaaatttctttcaagctttttcccaaaaatttggaagtcattttaaaaagtattgtggttttattgttttctatcctttttaaatgaatttttttcttagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagccttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactga

SEQ ID NO: 4456 - DNA, 516 bp, Artificial Sequence
  Synthetic oligonucleotide
tatctttgagcatgtggtaaaaggtataaggtgaattggtcagtgtaggggagcaataagaacagcatgctgttctttggatgatgatatatgggcaaaatgttcttgattatctcttctttaaatttcctaatgtttttttcttcaggatcctataactcatctctgatacatataattaaatatttaataagttgtagtccgacatgctcaaatggaaaaattggaaagttacaattttcaggtttaaagtttgtaacattccatttttacccttcaaattctttttatcctctcccttccacagtatagatagtaagacttgttttagtatattagatcttacctcccaattgaaatggaaatgtagcagaggtgttcatagtccaaactattttaaattctgtttttaaaagcaaatttctttcaagctttttcccaaaaatttggaagtcattttaaaaagtattgtggttttattgttttctatcctttttaaatgaatttttttcttag

SEQ ID NO: 4457 - DNA, 143 bp, Artificial Sequence
  Synthetic oligonucleotide
atctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttg

SEQ ID NO: 4458 - DNA, 170 bp, Artificial Sequence
  Synthetic oligonucleotide
gttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaag

SEQ ID NO: 4459 - DNA, 130 bp, Artificial Sequence
  Synthetic oligonucleotide
tatctgcaccaagaaaagaaactgcttcatggagacataaagtcttcaaatgttgtaattaaaggcgattttgaaacaattaaaatctgtgatgtaggagtctctctaccactggatgaaaatatgactg

SEQ ID NO: 4460 - DNA, 177 bp, Artificial Sequence
  Synthetic oligonucleotide
tgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaag

SEQ ID NO: 4461 - DNA, 883 bp, Artificial Sequence
  Synthetic oligonucleotide
ataaaacttttgatgaaagtgattttgatgatgaagcatactatgcagccttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaagg

SEQ ID NO: 4462 - DNA, 7004 bp, Homo sapiens
gaggacactgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatgtaagtctgcaatagataaatatacatgtatttcagacatgtaaaaataccgagccctatgaaataatctgaagtttgcatgacttggaagtagaatatactatgttctctatttttagagctgtcttgttatttggtagaataaatgaatgtgtgtgtatattttttaggtcttaattgaaggcttaaaaatctgtcattttctttttgggctccaataaaatttaaaagacacttgcctagtagaattaagattttgattattcttatttgtgggagttttgttttgttttattttaagcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctga

SEQ ID NO: 4463 - DNA, 4521 bp, Homo sapiens
gtagcctaggtgacagagcaagactctgtctcaaataaataaaataaaataaagttagtgtaggaagagaaaaagtgagaactttgccaaagggagccagtcctagagtctggctttataaaacgttattgagtattttgagggtttcatttgtttgcttttaattctaaatgtttcttctaggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctga

SEQ ID NO: 4464 - DNA, 2734 bp, Homo sapiens
gtggagccatggtatcaggtgatacaggcaccactcagtatcaccctggtgacaaaatcaagtgcacaggggccatctgactcacaggcatctcttcctttcaggagcacttgctgaaataccattttttcactgataaaaggcagtaaacaaaaaatcctaggcagagccagaagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctga

SEQ ID NO: 4465 - DNA, 2476 bp, Homo sapiens
gaaatacaaggtttgttggctttagtgaactagaacaaatacttataacttggcaggtaatgtaagtacaaattaaagttatctgccctcttaggatattcatgaaccaatgttgttacctattaaaggcacttgcttagactcagggacttaaatcattcaggggggctgaaaccagaagttgaacatctgtcctgaagctttggggcaactgacagtgctactcttgccctttggttaagaagtctcttttagttcaggagcctccttttgcttcccttagccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctga

SEQ ID NO: 4466 - DNA, 1788 bp, Homo sapiens
atttggttaagcaacatgaactactttactctcaggaacgaaggaaacccaagagagaatttctaccaggttaaatgatggcccctagctctggggagtgggaaggagtagagatggatgattagatgaatgactggacacacttcagctggtgtcatggtagaagtgattaaaaattttcatgttttagcagctgaacttgaaagatatgatgtgccacatttatagccctggccatcttttagaagtgagctcaaagcttagggaagatgaatggtgacaaattatcctcattcttcagtcactcctaactcttttattcttttttcaatagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctga

SEQ ID NO: 4467 - DNA, 2404 bp, Homo sapiens
atcatatccactctcagcctgtatcttgctgggctgaagcttcagttaaattttgttctcttaaataggagttcttttttgtttttgacaccttaaattacgcctttccaagactttacaagtgtttttattttttgaggtttttttgagataggttctcactctgtcacccaggctggagtacagtggtgcgatctcggctcactgcagcttctgcctcctgggttcaagtgattctcatgtcttggcctcccgagtagctgggattataggtgtgtgccaccacccccagctaatttttgaattttttttaagagggtttcaccatgttggccaggttggtcttgaacccctgacctctaagtggtccacctgtcttggtctcccaaagtgcttggattacaggcatgagccactgtgcccagccagggtctctttttgttgcccaggctggtctttaatgaaaaagacctcttaggagttaaagtgtggtgtgcagaatgtccaacagtatgccacatgtaaacataccatggtttgatcagggcaggcatcctatccttgtttccaaagccctttttggggatgttcaacgtgtgataattttggcctaaacagcacatttgcaacccaagcatgtattcccactgattattaaattgattttgtgccttagagtattcagacatctcatattgctggcttttacataattcttcattcatttttcaccccctcagaggattctcctcatctttacattaaaggagtcctttttccctggagtaacctttctacttttctatttaccataaggcagtgtttcctcccagtaccttacctttggggcctgtggaatgcatttgcattgataccaagtgaaatattttaaaggcccgcattgtatcattgttcattctcagaaatttaggaagtgtgatggattttttgttgttttggttttcctctctcctgccagaatattgatcttagtggtagggttacagacactccagttctatgccctctttagataattgttggacaccttctcttccccatgaatacaccatagccttggacaccttgcttccttcacaggttcaaatgagtttctcctatgtgacattggtccaaacttaatctaattcttccaaacatttaaggtcctcgggtttttcagttgggcaattacagtatgcttaggagtagcttcagctttttggattgcccaagtcagccctgggattactggagtacaatcccctgcataacccaggatgcagatggatgacccaatttacattctgcctttctatatcagttttttgcattctcaagaagcttatattgtatatttcagagcacccttatcaccaactccaggtagattcttgtggaatttgtcgttttcaagtataggaaattcttaattgttctttttggtgggagattaaccaaggcactttagaagggggatatgtggatatctgaatattctttctactttttcccctctaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctga

SEQ ID NO: 4468 - DNA, 2564 bp, Homo sapiens
atcatatccactctcagcctgtatcttgctgggctgaagcttcagttaaattttgttctcttaaataggagttcttttttgtttttgacaccttaaattacgcctttccaagactttacaagtgtttttattttttgaggtttttttgagataggttctcactctgtcacccaggctggagtacagtggtgcgatctcggctcactgcagcttctgcctcctgggttcaagtgattctcatgtcttggcctcccgagtagctgggattataggtgtgtgccaccacccccagctaatttttgaattttttttaagagggtttcaccatgttggccaggttggtcttgaacccctgacctctaagtggtccacctgtcttggtctcccaaagtgcttggattacaggcatgagccactgtgcccagccagggtctctttttgttgcccaggctggtctttaatgaaaaagacctcttaggagttaaagtgtggtgtgcagaatgtccaacagtatgccacatgtaaacataccatggtttgatcagggcaggcatcctatccttgtttccaaagccctttttggggatgttcaacgtgtgataattttggcctaaacagcacatttgcaacccaagcatgtattcccactgattattaaattgattttgtgccttagagtattcagacatctcatattgctggcttttacataattcttcattcatttttcaccccctcagaggattctcctcatctttacattaaaggagtcctttttccctggagtaacctttctacttttctatttaccataaggcagtgtttcctcccagtaccttacctttggggcctgtggaatgcatttgcattgataccaagtgaaatattttaaaggcccgcattgtatcattgttcattctcagaaatttaggaagtgtgatggattttttgttgttttggttttcctctctcctgccagaatattgatcttagtggtagggttacagacactccagttctatgccctctttagataattgttggacaccttctcttccccatgaatacaccatagccttggacaccttgcttccttcacaggttcaaatgagtttctcctatgtgacattggtccaaacttaatctaattcttccaaacatttaaggtcctcgggtttttcagttgggcaattacagtatgcttaggagtagcttcagctttttggattgcccaagtcagccctgggattactggagtacaatcccctgcataacccaggatgcagatggatgacccaatttacattctgcctttctatatcagttttttgcattctcaagaagcttatattgtatatttcagagcacccttatcaccaactccaggtagattcttgtggaatttgtcgttttcaagtataggaaattcttaattgttctttttggtgggagattaaccaaggcactttagaagggggatatgtggatatctgaatattctttctactttttcccctctaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaaggtactgctccttttcttctgtgcagttcagggagggtagtcacaagcaggtccgaggcaggctggcccacagagaagtggcttagtcttgctgtagttctggagctgcatcttgacctgcttgacctgaccttagacaatctctctccttctctcaatagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctga

SEQ ID NO: 4469 - DNA, 5460 bp, Homo sapiens
gaggacactgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcggtaagggcacctctgcagaatttcagcttcccatcaatctctcagcctacagaggttcaaaagccagagtccatgcagatgttgcagtgagtcctgtgtcacttggtagaattttacatgcattgtatatagcaagctactgatggcttccattggatgtttggctacactccatcccaccttactgttaggatataaagtaacatgcttacagactacctagcttcttccggccagtttcttcatcaggcatggtaggccgtagctgcctttccacagataagtatggttctattaaaaatgctaattagcctggtttgatcagtatacattgtatacatgtgttgaaataccactctgtattccataaatttgtacaattattacatgtcaactaaaaataaaagggaaaaaatttgttaatgttttacctgtagagcagattataaggataataaagacattctcactcaga

SEQ ID NO: 4470 - DNA, 5853 bp, Homo sapiens
gaggacactgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcggtaagggcacctctgcagaatttcagcttcccatcaatctctcagcctacagaggttcaaaagccagagtccatgcagatgttgcagtgagtcctgtgtcacttggtagaattttacatgcattgtatatagcaagctactgatggcttccattggatgtttggctacactccatcccaccttactgttaggatataaagtaacatgcttacagactacctagcttcttccggccagtttcttcatcaggcatggtaggccgtagctgcctttccacagataagtatggttctattaaaaatgctaattagcctggtttgatcagtatacattgtatacatgtgttgaaataccactctgtattccataaatttgtacaattattacatgtcaactaaaaataaaagggaaaaaatttgttaatgttttacctgtagagcagattataaggataataaagacattctcactcagatttcaatattctttcttaaactggggctaaaagggtggacttaatgacaccaactagccagaaattacaaatttggcataacagtaaataatttcacatgtaaaaacaaatactttggccaggcacagtggctcacacctataatctcagcacgttgggaggccaaggcgggtggatcacaatgtcaggagttcaagatcagcctggccaagatggtgaaaccccatctctactaaaaatacaaaaaattagccaggcctggtggcgggcgcctgtaatcccagctactcgggaggctgaggcagagaattgcttgaacccaggaggcggagctttcagtgagccgagatcgtgccactgcactccagtctgggcaacagagcaagactctgt

SEQ ID NO: 4471 - DNA, 3138 bp, Homo sapiens
gaggacactgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaaggtaaacctaactcttttcaccatgcctccattctggaataggccagccatatttttgggttaaagataattctctttttagagtcatgtaaagacctgataaactttataaagatgaaaatattagaagaaaaacagtaaacatttttatcttccaggca

SEQ ID NO: 4472 - DNA, 194 bp, Artificial Sequence
  Synthetic oligonucleotide
ctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaa

SEQ ID NO: 4473 - DNA, 207 bp, Artificial Sequence
  Synthetic oligonucleotide
aaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaag

SEQ ID NO: 4474 - DNA, 172 bp, Artificial Sequence
  Synthetic oligonucleotide
tgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcag

SEQ ID NO: 4475 - DNA, 133 bp, Artificial Sequence
  Synthetic oligonucleotide
ttgaaagaactagaagaagaatgggtcaaactgccaacaagtgctcctagacctactcgatttcttcgttcccaacaagaactagaagctaaattggaacaacaacagtctgctggtggagatgctgaaggag

SEQ ID NO: 4476 - DNA, 165 bp, Artificial Sequence
  Synthetic oligonucleotide
accacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaag

SEQ ID NO: 4477 - DNA, 129 bp, Artificial Sequence
  Synthetic oligonucleotide
cacatcaatgattctgctcctgaagtcagagatgccgcatttgaagcattgggtactgctttgaaggtggttggcgagaaagcagtaaacccattcctagctgatgtggacaaactcaagcttgataag

SEQ ID NO: 4478 - DNA, 183 bp, Artificial Sequence
  Synthetic oligonucleotide
atcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaag

SEQ ID NO: 4479 - DNA, 186 bp, Artificial Sequence
  Synthetic oligonucleotide
gtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacag

SEQ ID NO: 4480 - DNA, 183 bp, Artificial Sequence
  Synthetic oligonucleotide
gtagcctaggtgacagagcaagactctgtctcaaataaataaaataaaataaagttagtgtaggaagagaaaaagtgagaactttgccaaagggagccagtcctagagtctggctttataaaacgttattgagtattttgagggtttcatttgtttgcttttaattctaaatgtttcttctag

SEQ ID NO: 4481 - DNA, 126 bp, Artificial Sequence
  Synthetic oligonucleotide
gctgtgaggactgctgccataaccctgcttggcgtgatgtatctgtatgttggtccctctttgcgaatgttctttgaggatgagaagcctgccctcctatcccagatagatgcagaatttgagaag

SEQ ID NO: 4482 - DNA, 160 bp, Artificial Sequence
  Synthetic oligonucleotide
gtaaacctaactcttttcaccatgcctccattctggaataggccagccatatttttgggttaaagataattctctttttagagtcatgtaaagacctgataaactttataaagatgaaaatattagaagaaaaacagtaaacatttttatcttccaggca

SEQ ID NO: 4483 - DNA, 129 bp, Artificial Sequence
  Synthetic oligonucleotide
aacaatgttcgagctgctgccctagcgactgtgaatgcttgggcagaacagactggcatgaaggaatggctggaaggagaagatctttctgaagagctcaaaaaggaaaatcctttcttgaggcaagag

SEQ ID NO: 4484 - DNA, 136 bp, Artificial Sequence
  Synthetic oligonucleotide
ccaacttctaaagatcaggtattggccatgctagagaaagccaaagttaacatgccagccaagcctgctccacccactaaagcaacttctaaaccaatgggagggtccgctccagccaaattccagcctgcatcag

SEQ ID NO: 4485 - DNA, 126 bp, Artificial Sequence
  Synthetic oligonucleotide
agtgcacaagggaagaagatgccaagcaaaaccagcttaaaggaggatgaagacaaatccgggcctatttttattgttgttccaaatggaaaagagcaaaggatgaaagatgaaaaaggattgaag

SEQ ID NO: 4486 - DNA, 150 bp, Artificial Sequence
  Synthetic oligonucleotide
gtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgat

SEQ ID NO: 4487 - DNA, 301 bp, Artificial Sequence
  Synthetic oligonucleotide
gtaagtctgcaatagataaatatacatgtatttcagacatgtaaaaataccgagccctatgaaataatctgaagtttgcatgacttggaagtagaatatactatgttctctatttttagagctgtcttgttatttggtagaataaatgaatgtgtgtgtatattttttaggtcttaattgaaggcttaaaaatctgtcattttctttttgggctccaataaaatttaaaagacacttgcctagtagaattaagattttgattattcttatttgtgggagttttgttttgttttattttaag

SEQ ID NO: 4488 - DNA, 204 bp, Artificial Sequence
  Synthetic oligonucleotide
cacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaag

SEQ ID NO: 4489 - DNA, 136 bp, Artificial Sequence
  Synthetic oligonucleotide
gttggagaaccaaaggatgtcattcgtaaagatgttcgtgccatcctgaaccggatgtgccttgtctacccagctagcaagatgtttccctttatcatggaaggaaccaaatccaaaaactctaagcagagagcag

SEQ ID NO: 4490 - DNA, 174 bp, Artificial Sequence
  Synthetic oligonucleotide
gtggagccatggtatcaggtgatacaggcaccactcagtatcaccctggtgacaaaatcaagtgcacaggggccatctgactcacaggcatctcttcctttcaggagcacttgctgaaataccattttttcactgataaaaggcagtaaacaaaaaatcctaggcagagccaga

SEQ ID NO: 4491 - DNA, 194 bp, Artificial Sequence
  Synthetic oligonucleotide
agtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaat

SEQ ID NO: 4492 - DNA, 173 bp, Artificial Sequence
  Synthetic oligonucleotide
ctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaa

SEQ ID NO: 4493 - DNA, 283 bp, Artificial Sequence
  Synthetic oligonucleotide
gaaatacaaggtttgttggctttagtgaactagaacaaatacttataacttggcaggtaatgtaagtacaaattaaagttatctgccctcttaggatattcatgaaccaatgttgttacctattaaaggcacttgcttagactcagggacttaaatcattcaggggggctgaaaccagaagttgaacatctgtcctgaagctttggggcaactgacagtgctactcttgccctttggttaagaagtctcttttagttcaggagcctccttttgcttcccttag

SEQ ID NO: 4494 - DNA, 121 bp, Artificial Sequence
  Synthetic oligonucleotide
gatccgggctgtttctccacacttcgatgacatgcacagtaatacagcatccacaatcaatttcattatctcccaagtagccagtggtgacatcaacacaagtatccaagctctgacacag

SEQ ID NO: 4495 - DNA, 180 bp, Artificial Sequence
  Synthetic oligonucleotide
atcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcg

SEQ ID NO: 4496 - DNA, 868 bp, Artificial Sequence
  Synthetic oligonucleotide
gtaagggcacctctgcagaatttcagcttcccatcaatctctcagcctacagaggttcaaaagccagagtccatgcagatgttgcagtgagtcctgtgtcacttggtagaattttacatgcattgtatatagcaagctactgatggcttccattggatgtttggctacactccatcccaccttactgttaggatataaagtaacatgcttacagactacctagcttcttccggccagtttcttcatcaggcatggtaggccgtagctgcctttccacagataagtatggttctattaaaaatgctaattagcctggtttgatcagtatacattgtatacatgtgttgaaataccactctgtattccataaatttgtacaattattacatgtcaactaaaaataaaagggaaaaaatttgttaatgttttacctgtagagcagattataaggataataaagacattctcactcagatttcaatattctttcttaaactggggctaaaagggtggacttaatgacaccaactagccagaaattacaaatttggcataacagtaaataatttcacatgtaaaaacaaatactttggccaggcacagtggctcacacctataatctcagcacgttgggaggccaaggcgggtggatcacaatgtcaggagttcaagatcagcctggccaagatggtgaaaccccatctctactaaaaatacaaaaaattagccaggcctggtggcgggcgcctgtaatcccagctactcgggaggctgaggcagagaattgcttgaacccaggaggcggagctttcagtgagccgagatcgtgccactgcactccagtctgggcaacagagcaagactctgt

SEQ ID NO: 4497 - DNA, 188 bp, Artificial Sequence
  Synthetic oligonucleotide
ctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgag

SEQ ID NO: 4498 - DNA, 334 bp, Artificial Sequence
  Synthetic oligonucleotide
atttggttaagcaacatgaactactttactctcaggaacgaaggaaacccaagagagaatttctaccaggttaaatgatggcccctagctctggggagtgggaaggagtagagatggatgattagatgaatgactggacacacttcagctggtgtcatggtagaagtgattaaaaattttcatgttttagcagctgaacttgaaagatatgatgtgccacatttatagccctggccatcttttagaagtgagctcaaagcttagggaagatgaatggtgacaaattatcctcattcttcagtcactcctaactcttttattcttttttcaatag

SEQ ID NO: 4499 - DNA, 140 bp, Artificial Sequence
  Synthetic oligonucleotide
tgtctctggagaatggttcgactgttgcctgataccatcaatagcattaacctagacagaattcttctggatatccacattttcatgaaggtcttccccaaagagaaactgaagcaatgcaaaagtgaatttcccataag

SEQ ID NO: 4500 - DNA, 138 bp, Artificial Sequence
  Synthetic oligonucleotide
atcctggaccacctaacgatgatcgacaacaaaaacgagtctgagctggaggcccatctctgccggatgatgaagcacagtatggaccagactgggagcaagtctgataaggaaacagaaaagggagcatctcgaata

SEQ ID NO: 4501 - DNA, 1521 bp, Artificial Sequence
  Synthetic oligonucleotide
atcatatccactctcagcctgtatcttgctgggctgaagcttcagttaaattttgttctcttaaataggagttcttttttgtttttgacaccttaaattacgcctttccaagactttacaagtgtttttattttttgaggtttttttgagataggttctcactctgtcacccaggctggagtacagtggtgcgatctcggctcactgcagcttctgcctcctgggttcaagtgattctcatgtcttggcctcccgagtagctgggattataggtgtgtgccaccacccccagctaatttttgaattttttttaagagggtttcaccatgttggccaggttggtcttgaacccctgacctctaagtggtccacctgtcttggtctcccaaagtgcttggattacaggcatgagccactgtgcccagccagggtctctttttgttgcccaggctggtctttaatgaaaaagacctcttaggagttaaagtgtggtgtgcagaatgtccaacagtatgccacatgtaaacataccatggtttgatcagggcaggcatcctatccttgtttccaaagccctttttggggatgttcaacgtgtgataattttggcctaaacagcacatttgcaacccaagcatgtattcccactgattattaaattgattttgtgccttagagtattcagacatctcatattgctggcttttacataattcttcattcatttttcaccccctcagaggattctcctcatctttacattaaaggagtcctttttccctggagtaacctttctacttttctatttaccataaggcagtgtttcctcccagtaccttacctttggggcctgtggaatgcatttgcattgataccaagtgaaatattttaaaggcccgcattgtatcattgttcattctcagaaatttaggaagtgtgatggattttttgttgttttggttttcctctctcctgccagaatattgatcttagtggtagggttacagacactccagttctatgccctctttagataattgttggacaccttctcttccccatgaatacaccatagccttggacaccttgcttccttcacaggttcaaatgagtttctcctatgtgacattggtccaaacttaatctaattcttccaaacatttaaggtcctcgggtttttcagttgggcaattacagtatgcttaggagtagcttcagctttttggattgcccaagtcagccctgggattactggagtacaatcccctgcataacccaggatgcagatggatgacccaatttacattctgcctttctatatcagttttttgcattctcaagaagcttatattgtatatttcagagcacccttatcaccaactccaggtagattcttgtggaatttgtcgttttcaagtataggaaattcttaattgttctttttggtgggagattaaccaaggcactttagaagggggatatgtggatatctgaatattctttctactttttcccctctag

SEQ ID NO: 4502 - DNA, 152 bp, Artificial Sequence
  Synthetic oligonucleotide
gcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaag

SEQ ID NO: 4503 - DNA, 160 bp, Artificial Sequence
  Synthetic oligonucleotide
gtactgctccttttcttctgtgcagttcagggagggtagtcacaagcaggtccgaggcaggctggcccacagagaagtggcttagtcttgctgtagttctggagctgcatcttgacctgcttgacctgaccttagacaatctctctccttctctcaatag

SEQ ID NO: 4504 - DNA, 198 bp, Artificial Sequence
  Synthetic oligonucleotide
aaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgct

SEQ ID NO: 4505 - DNA, 671 bp, Artificial Sequence
  Synthetic oligonucleotide
ttttcctttcagtttgtgagctcttctctgtcgccctgaagggtcactgtattctgtatgaatgcatggcatgatacaactaatttaagagtcttttataaataaagtttgcattaactatacctgactcccaagatgctccatatcatggagtgttgggcagcaattttttaacttttggtaccagctgggtattcagccagttagagaaaggttaattactgcttacagagcttccctttttcttggctcacagacttggagctgtcttttattcctttggaatggaaggaactctccttccctgctctccacaaacagctcctagggagcagaaaaatctcatccttccttgttttgagattttggtcatgatttccctccaattatcaccagtcgtttcaagaagctcttgggcatcctaccactttgctgaccaaaggcacacaagattgcgcccagagattggctgggcttcagtggttctcacactacaactagatttgtgttcatttgactaatggagtttgggaaatcttagtggtttgctgcttggttgtatgagtctcttttggtccaggctaacagttgcttcacattcagtcagagtaaggatgagaaagtgagctgagtattcacctctggaataaattccacaggacctccctcca

SEQ ID NO: 4506 - DNA, 79 bp, Artificial Sequence
  Synthetic oligonucleotide
gaggacactgcggggtgtgcggcggcccaagcggtttcaaacggcttagagcaggccgcttggttctgacccagctgag

SEQ ID NO: 4507 - DNA, 20 bp, Artificial Sequence
  Synthetic oligonucleotide
gaaatactcttaattctaag

SEQ ID NO: 4508 - DNA, 74 bp, Artificial Sequence
  Synthetic oligonucleotide
gaaaacctggaagcacaatgggagatgacagtgagtggttgaaactgccagttgatcagaaatgtgaacacaag

SEQ ID NO: 4509 - DNA, 101 bp, Artificial Sequence
  Synthetic oligonucleotide
gtggtgatgatggtgatgaggtgccacaaatagatgcttatgagcttttagaagctgtagaaatcctttccaaacttcccaaagacttttatgacaaaatt

SEQ ID NO: 4510 - DNA, 70 bp, Artificial Sequence
  Synthetic oligonucleotide
gaggcaaaaaaatggcaagagagaaaagaggccctggagtctgtagaagtactaataaaaaaccccaaac

SEQ ID NO: 4511 - DNA, 44 bp, Artificial Sequence
  Synthetic oligonucleotide
tggaagctggcgattatgcagatttagtaaaagcattaaagaag

SEQ ID NO: 4512 - DNA, 105 bp, Artificial Sequence
  Synthetic oligonucleotide
gttgttggaaaggacaccaatgtcatgttggtggctttggcagcaaaatgtcttactggcctggctgttgggctaaggaagaaatttggacaatatgcaggacat

SEQ ID NO: 4513 - DNA, 90 bp, Artificial Sequence
  Synthetic oligonucleotide
gttgtgccaaccatcttggagaaattcaaagagaagaaacctcaagtggtacaagccctgcaggaggcaattgatgcaatcttccttact

SEQ ID NO: 4514 - DNA, 114 bp, Artificial Sequence
  Synthetic oligonucleotide
gctggtgggccaccaaaaaaggggaaaccagctgcaccaggaggcgcagggaatactggaaccaagaacaagaaaggactggagactaaagaaatagtggagcctgagctctcg

SEQ ID NO: 4515 - DNA, 111 bp, Artificial Sequence
  Synthetic oligonucleotide
atagaagtatgtgaagaaaaagcttcagctgttcttccccctacctgtatacagcttcttgacagcagtaactggaaagaaaggctggcttgtatggaagagttccagaag

SEQ ID NO: 4516 - DNA, 93 bp, Artificial Sequence
  Synthetic oligonucleotide
gctgttgagctaatggaccgaactgaaatgccatgccaggcattagtgaggatgctagccaagaaacctggatggaaagaaactaattttcag

SEQ ID NO: 4517 - DNA, 95 bp, Artificial Sequence
  Synthetic oligonucleotide
gttgtgtcaatggctttctcacaaaagaatcccaaaaatcagtcagaaactctgaattggctatcaaatgccataaaagaatttggtttttctgg

SEQ ID NO: 4518 - DNA, 58 bp, Artificial Sequence
  Synthetic oligonucleotide
gttgaatgtcaaagctttcattagcaatgtgaagacagctcttgctgcaacaaaccca

SEQ ID NO: 4519 - DNA, 76 bp, Artificial Sequence
  Synthetic oligonucleotide
atgcagggacaaagtccacctgctccaaccagaggaatttccaagcatagcacaagtggtacagatgaaggagaag

SEQ ID NO: 4520 - DNA, 64 bp, Artificial Sequence
  Synthetic oligonucleotide
atggagatgaaccagatgacgggagcaatgatgtcgttgatcttttgccgaggacggagatcag

SEQ ID NO: 4521 - DNA, 97 bp, Artificial Sequence
  Synthetic oligonucleotide
tgataaaatcacttcagagttggtatctaagattggtgataagaattggaagattaggaaagaaggcctagatgaagtggcaggtattattaatgac

SEQ ID NO: 4522 - DNA, 78 bp, Artificial Sequence
  Synthetic oligonucleotide
gcaaaatttatccaaccgaatataggtgaacttccaactgccttgaagggtcgactcaatgattcaaataaaatcttg

SEQ ID NO: 4523 - DNA, 114 bp, Artificial Sequence
  Synthetic oligonucleotide
gtacagcaaacgctgaatatcctgcaacaactggcagtagccatgggcccaaatattaagcaacatgtaaaaaatttaggcatccctatcatcacagtccttggagacagcaag

SEQ ID NO: 4524 - DNA, 87 bp, Artificial Sequence
  Synthetic oligonucleotide
cttctgggctggctggctgagaaactacctactcttcgttccacccctacagaccttatcctttgtgttcctcatctctactcctgc

SEQ ID NO: 4525 - DNA, 108 bp, Artificial Sequence
  Synthetic oligonucleotide
ctagaagatcgaaatggagatgtgcgaaagaaggcccaagatgccttgccattcttcatgatgcatttaggatatgaaaaaatggccaaggctactgggaaactaaag

SEQ ID NO: 4526 - DNA, 89 bp, Artificial Sequence
  Synthetic oligonucleotide
cacctgctgaagattgtatttccagcagtacagaacccaaacctgatccaaaaaaggccaaagctccaggattatcctctaaagcaaag

SEQ ID NO: 4527 - DNA, 97 bp, Artificial Sequence
  Synthetic oligonucleotide
ccaagcccgaagcatgagtgggcatcctgaggcagcccagatggtccgccgagaattccagctggatctagatgagattgagaatgacaatggtaca

SEQ ID NO: 4528 - DNA, 58 bp, Artificial Sequence
  Synthetic oligonucleotide
gtccgatgtgaaatgccagaacttgttcagcacaaactggatgacatttttgagccag

SEQ ID NO: 4529 - DNA, 19 bp, Artificial Sequence
  Synthetic oligonucleotide
tccttattcctgaacccaa

SEQ ID NO: 4530 - DNA, 76 bp, Artificial Sequence
  Synthetic oligonucleotide
tgccctacttgttttgctccaagacagcctgctagcaacagccagttctcccaaattctcagagcttgttatgaag

SEQ ID NO: 4531 - DNA, 49 bp, Artificial Sequence
  Synthetic oligonucleotide
gaccctaaagaccctgctacacaccttatgcaaattaaaagggcccaag

SEQ ID NO: 4532 - DNA, 84 bp, Artificial Sequence
  Synthetic oligonucleotide
gatgaaaaatcatcaaaggccaaagtgaatgatttcttagctgagatttttaagaagattggctctaaagaaaacactaaagag

SEQ ID NO: 4533 - DNA, 66 bp, Artificial Sequence
  Synthetic oligonucleotide
ggactagcagagttatatgaatataagaagaaatactcagatgctgacattgaaccatttctgaaa

SEQ ID NO: 4534 - DNA, 54 bp, Artificial Sequence
  Synthetic oligonucleotide
aattcctcacagttcttccagagctatgtcgaaagaggccttcgggtgattgag

SEQ ID NO: 4535 - DNA, 40 bp, Artificial Sequence
  Synthetic oligonucleotide
atggagagggagggcaaaggtcgtatttccacttcaacag

SEQ ID NO: 4536 - DNA, 72 bp, Artificial Sequence
  Synthetic oligonucleotide
caagatgaccgacctcctttgacctctttgctctccaaaccagcagttcctactgtcgcctcttccacagac

SEQ ID NO: 4537 - DNA, 11 bp, Artificial Sequence
  Synthetic oligonucleotide
atgctccacag

SEQ ID NO: 4538 - DNA, 37 bp, Artificial Sequence
  Synthetic oligonucleotide
caaactctctcagctccgggagtcacgggagcagcac

SEQ ID NO: 4539 - DNA, 67 bp, Artificial Sequence
  Synthetic oligonucleotide
cagcattcagacctggattctaaccagactcactcttcaggaactgtgacctcctcctcctccacag

SEQ ID NO: 4540 - DNA, 50 bp, Artificial Sequence
  Synthetic oligonucleotide
ctaacatagacgacttgaaaaaaagactggagagaataaagagcagtcgc

SEQ ID NO: 4541 - DNA, 115 bp, Artificial Sequence
  Synthetic oligonucleotide
ctagaagactgtccgtggatgagtttagtgtacagacttgtaaacagctgccccctctctgctcagtctagttcccagatccttttcttttctttttaattgctcatttgtaaaa

SEQ ID NO: 4542 - DNA, 54 bp, Artificial Sequence
  Synthetic oligonucleotide
ttgtcctaatctttcctagctttttaatagttaatattagaaactctttaatag

SEQ ID NO: 4543 - DNA, 2566 bp, Homo sapiens
tcaggatgttgttcaatctttaaagataatgctgtgtcagttttatttcatagcatttattagctgaacatttcctgactctcttaactgaattgctcgctatttttaggtaagatattcatttgacactgctttgcaggattaaaagagcaaagaattgtattaattggtaacatttatgactgagttgcatgacttcactaagttataataccttattaaatttcttttcttttttattcccatatccatcatttctgccctattataggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaattaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctc

SEQ ID NO: 4544 - DNA, 2914 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggggaaaaattgaggaagcagtgaatgcatttaaagaactagtacgcaaataccctcagagtccacgagcaagatatgggaaggcgcagtgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctaggtcatatgagaggttccctgcttaccctgcagagattagttcaactatttcccaatgatacttccttaaaaaatgaccttggcgtgggatacctcttgataggagataatgacaatgcaaagaaagtttatgaagaggtgctgagtgtgacacctaatgatggctttgctaaagtccattatggcttcatcctgaaggcacagaacaaaattgctgagagcatcccatatttaaaggaaggaatagaatccggagatcctggcactgatgatgggagattttatttccacctgggggatgccatgcagagggttgggaacaaagaggcatataagtggtatgagcttgggcacaagagaggacactttgcatctgtctggcaacgctcactctacaatgtgaatggactgaaagcacagccttggtggaccccaaaagaaacgggctacacagagttagtaaagtctttagaaagaaactggaagttaatccgagatgaaggccttgcagtgatggataaagccaaaggtctcttcctgcctgaggatgaaaacctgagggaaaaaggggactggagccagttcacgctgtggcagcaaggaagaagaaatgaaaatgcctgcaaaggagctcctaaaacctgtaccttactagaaaagttccccgagacaacaggatgcagaagaggacagatcaaatattccatcatgcaccccgggactcacgtgtggccgcacacagggcccacaaactgcaggctccgaatgcacctgggcttggtgattcccaaggaaggctgcaagattcgatgtgccaacgagaccaagtatgggtcctctgttatccgtcatatccgtcacctcagaggatgagagtttgttacaacacagttgtgttcctttggattacttatcttcttttgtagctgaagtagactggagcaaagtgatattaatccaaactcttaagtctatatcccttcttggtgctttctattagcctggagacattgcccagctctagggctgccctcctccattatttctcggcagagtacttatctagttgaggagctgccttgtttctctctctgggtagacagatgtgcattcagagtcagccaacatgcattgagccctgcagatgttatgcattgtgcttcctgctttgcaacttgacttattcatgactacaagaagtacccctaactgaagaactcaccccatgatatttatacgttttgatatagaggagatggtatggtgcaatggaagctggctgcctttttcaaatcccagctctaacacctaacctgtgtaaccttggctagttacttaatcc

SEQ ID NO: 4545 - DNA, 2121 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagaggactcatttgcgtctggtgaaagccaggcggcttgcaccatgtcctgggacttcagccatcctttcatgtgttgacccttcttaaagaatggaagggggaactgaataaagaagataacagcttctagctaagaaggatgatgcattagtttgccaaatatataggctccttttgtgtgctatgctctgtggagcgctctgaaagcaaagcaagtaactacaatgtaaagaggtagagactatgaacaaaatgctgtgggaacaccaaggaggaaatgacacactgctggcaggagatggaaagcaactggagtcttcatggagcgatgacatttgagctggtcctcaagtagtgggtgaggattacatccatgcaagagccctgtgaacccagatactgaagtatgtctaatgacaaggatgataagttgatatggaaaaaaatatcacaggtgtttctgctcacagcaagcccagcagtactccaagagcagtacttaacttgggtgtcatgggctatgctctctatacagaagattacattagagtcttgtcttaaaaaccctttttgggaaaattatcataattcatttttttctaatatccaatgacttttacgcttttgctactttgattcatcagtacgttgatgataccttctcctctttgtcccattcctgcttcatgataatttaatgaaattaaagtaatggatttaattagcacctacatctatgattatatgtatatattatttatctgaaacctttggggtgggccagctaccacaattaaaatatcaacttgattcaagttgtgtgaagcacactttaaacttgaaataaaagtgaataaaatctatttatacag

SEQ ID NO: 4546 - DNA, 1872 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagaaacaaatagaaaaacagatgatccagaacaaaaagcaaaagttaagaaaaagaagcctaaacttttaaataaatttgataagactattaaagctgaacttgatgctgcagaaaaactccgtaaaaggagcctccacccaggctgaagtgcagtggcacagtctcggctaactggaacctctgcttcctgagtttaagcagttctcctcctgagtagctgggattacagatgctcaccaccatgcctggctaatttttgtatttttagtagagacagggtttcaccatgttgcccaggctggtcttgaactcctgacctcaagtgatccacccgtctcagcctccgaaagtgctgggattacaggcgtgagccataagtgagattaaaataataataataataataataataacactgtcaagtatcatagaagtgcaagtttttaattttatagctccttgatgcaaaaagaaaaactaggtcagtccattactcaggatagtaattggtagatgaaatgacattcttcttacttagggttaacctcatgcacctccagttttcagggtaccttatttatattttaatttgtcgatatatttgaaatattacttgcatttctttatagatattacaattttgagaacaataaattgaaactgga

SEQ ID NO: 4547 - DNA, 3191 bp, Homo sapiens
ggccagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgtt

SEQ ID NO: 4548 - DNA, 3451 bp, Homo sapiens
ggccagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgttttggctatctcattgatttttcctttgactgttagctcaagaattgaaacacctcaactaaaacatttaaagatcctttaaaagcacttgtagactagaacttgatttattttttcccatctctcttcttttccccttctcttttctttctttttgtaaatgtttcaactaacttttattgaagttgaagtcacactttatccaactgcgtaatatttaagcttcaactaaaaacaagctttcagtcatgattagagggt

SEQ ID NO: 4549 - DNA, 916 bp, Homo sapiens
ggccagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaattt

SEQ ID NO: 4550 - DNA, 2090 bp, Homo sapiens
ggccagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcag

SEQ ID NO: 4551 - DNA, 1700 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttctttactaagctgatattttttattgtaatttgtttaggtttgtcagataggttcatacaaatttctatgtaaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaatatgtatcttaatgttgtacatattaaaattattcatcctaa

SEQ ID NO: 4552 - DNA, 3236 bp, Homo sapiens
ggccagtctcaagctctggtaggcaagtgcatgcagtgtgcctaaaacctgccagcagtacttttgagttttttttttggtttggttttactttagcatttattattcatggattgaagaaatcaaaatggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgtt

SEQ ID NO: 4553 - DNA, 3463 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattagaaggacccagtggggtagccaagagaaaaactaaggctaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgtt

SEQ ID NO: 4554 - DNA, 3799 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaatgcttaatttttaaaagaatattgtgacaacctgaaaacacaagatatgaaggctagaaaaaaagttatgaaataaactatagccttaagtatatggtacaatcgagaagcctaataaccagcctaattgtgaaaaacttatgtttgttttgtattcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagcccaggagtagttttggcttttttcttttgttatgctggatctaggtgcttgaacagtgttctcaacatccatctgtctatggaccctcaggaatgttggctttcttctcgggcagagtctcgtgtgctcatcttcaaccctactccttatggggtgggagataagaaagctgtgattggtgacaccctgggatatgtgagtgcccacttttaaactgttgggtaaagaaaaattggagtcctctaaggaagttagtgtgtttttaccagaaggaggaggaattgatgcactgaaagcaggcagatgatggagtttgtttcccctttttctacccatcccattcctacttctccccctgcccaaatacagagaggtgaatgggatgggccaaaataggtatttcaaaataagaagctgtggagctaaacattgggtactcatgggcataaagatggaaacaggagacactagaacttctagagaggggagagagggagggagacaagggttgaaaaactaactattggatactatgctcattacctgagtgatggaatcattcatattctaaatttcaatatcacgcaatatacccatgcagcaaacttgcacgtgctccttgaatctaaatagaagttgaagttatatttaaaaattaaaaaaaaaaaagctagggagaagagagagatctcattccaaacaattattggtcaacaatagttttagaccattgaaagaatataagagaatgttgacttgataataaatattgccatttagatgtcaggtgataaagtttattttgttgttaagctctctccattttgccccattcagtttaaaaggaaagtttttgtgtttaggaaactaaaggatgggtgatatgtagcagacccataaggttattttcatgaaaaacctagcttgggctaatctgaaagattcctcaataacagtctttggtgtcttatcctttcttctccatttgcctaagaatataattgtataagctggatgtttattccttggctatcgtttttacctaggaatcaatttctgcaagagctctgtaagccttacaaagcagaaagtcatccatttcttttttctttgttctcatttagtgcctcatttgatttcactttgtgtatctatttattgctccatgttaagtcaggtatgcatacatcatagaagtctgcctctcatttccatcttctttgccttatgtatcacttctcttgtgtcctattagagggagatgatctatgcttaaagctgttgggttatttttgataattatataacaccaacatgctgtgtctatagttcccatttattgattcaactaatatttctgagtatctacagcatgccgggactgggcaaggcatgggggatacaagagattgaggtggctgcaatccctccagtgaaatgctgcaaaataagcaaggggctgagagagaaagtaatgagactgaaacgattgtcagtacagcccactagtccctctgcctagaacgtgctcctgaatgtgctcctgctctgtgtggtgggctgcctttgtctctcccacgggacccagcccagtcatcacctctgcactcagacatctctgaccctcccaagtggctgcatcccacacactccagttatcgcactcatcaccttgcctcattcttggactttgctgccagactacgatttatctcgagcacctatcctagtaactgacactaataggcattcattgtttgtttattgaatggtgactatacaaaataaattatctaaaaatatttcaggtgtatatatactgttgaagaatattaggaagaagaaaaccgtgtgtgtgtgtttttgaagaacccaaaagattgttcagtaattgcagtgttttaactaccttggaagtta

SEQ ID NO: 4555 - DNA, 3844 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaatgcttaatttttaaaagaatattgtgacaacctgaaaacacaagatatgaaggctagaaaaaaagttatgaaataaactatagccttaagtatatggtacaatcgagaagcctaataaccagcctaattgtgaaaaacttatgtttgttttgtattcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagcccaggagtagttttggcttttttcttttgttatgctggatctaggtgcttgaacagtgttctcaacatccatctgtctatggaccctcaggaatgttggctttcttctcgggcagagtctcgtgtgctcatcttcaaccctactccttatggggtgggagataagaaagctgtgattggtgacaccctgggatatgtgagtgcccacttttaaactgttgggtaaagaaaaattggagtcctctaaggaagttagtgtgtttttaccagaaggaggaggaattgatgcactgaaagcaggcagatgatggagtttgtttcccctttttctacccatcccattcctacttctccccctgcccaaatacagagaggtgaatgggatgggccaaaataggtatttcaaaataagaagctgtggagctaaacattgggtactcatgggcataaagatggaaacaggagacactagaacttctagagaggggagagagggagggagacaagggttgaaaaactaactattggatactatgctcattacctgagtgatggaatcattcatattctaaatttcaatatcacgcaatatacccatgcagcaaacttgcacgtgctccttgaatctaaatagaagttgaagttatatttaaaaattaaaaaaaaaaaagctagggagaagagagagatctcattccaaacaattattggtcaacaatagttttagaccattgaaagaatataagagaatgttgacttgataataaatattgccatttagatgtcaggtgataaagtttattttgttgttaagctctctccattttgccccattcagtttaaaaggaaagtttttgtgtttaggaaactaaaggatgggtgatatgtagcagacccataaggttattttcatgaaaaacctagcttgggctaatctgaaagattcctcaataacagtctttggtgtcttatcctttcttctccatttgcctaagaatataattgtataagctggatgtttattccttggctatcgtttttacctaggaatcaatttctgcaagagctctgtaagccttacaaagcagaaagtcatccatttcttttttctttgttctcatttagtgcctcatttgatttcactttgtgtatctatttattgctccatgttaagtcaggtatgcatacatcatagaagtctgcctctcatttccatcttctttgccttatgtatcacttctcttgtgtcctattagagggagatgatctatgcttaaagctgttgggttatttttgataattatataacaccaacatgctgtgtctatagttcccatttattgattcaactaatatttctgagtatctacagcatgccgggactgggcaaggcatgggggatacaagagattgaggtggctgcaatccctccagtgaaatgctgcaaaataagcaaggggctgagagagaaagtaatgagactgaaacgattgtcagtacagcccactagtccctctgcctagaacgtgctcctgaatgtgctcctgctctgtgtggtgggctgcctttgtctctcccacgggacccagcccagtcatcacctctgcactcagacatctctgaccctcccaagtggctgcatcccacacactccagttatcgcactcatcaccttgcctcattcttggactttgctgccagactacgatttatctcgagcacctatcctagtaactgacactaataggcattcattgtttgtttattgaatggtgactatacaaaataaattatctaaaaatatttcaggtgtatatatactgttgaagaatattaggaagaagaaaaccgtgtgtgtgtgtttttgaagaacccaaaagattgttcagtaattgcagtgttttaactaccttggaagtta

SEQ ID NO: 4556 - DNA, 3817 bp, Homo sapiens
tagaaagacatagtgcttttagtgagcactgcaaatctaatgctcattttgaataccatttgtgctatgtaagttttatgtgattttgatgggcaaaaacatctttcacattttattatattaaagaaatatttcattttctttgtttctgcttaaatgtggcattgcttctgcttaaatgtggcattgcaaacaccttaccttatgatttccttatgagagtacaaacagatgaaattcagagcttttgctaactgctttattaccatgtaaagcaagttgaaagcaataccttccatgagatttggaattagctgtgtgtttcatttaattgctctctcaacccaatgaactagaagacgtgtgttagcttgagttgctctacatgaattaacagggaaacatacttaaaggaatactgatttcatgatgaatataagcagaaagagaattctaatttttccttttaaatactacagataatgatttaaaaatgtcatacacatgacaattttttcctagttaactaataaaatgaaattatatttaattttatttacatatatttgtcttcaaagaagcacgtgtattttaaggacatatgtttttgagctaaacattttaaattatctttgtatatattcttacaaattatgaaaaatttgttcttacgttgccagtgttcctttaattatagttacaaagtgtgagttaatactttgtgtaaagcactgccttcgtggtgccctcaattttataatattgcatgttaatgttttaagacaagtcatactatatttcaagatggaaaatatgacaagcttctagcattttttaatagttgatatttgatagagatttgcacctatttttagccaccataaagactagtgaattaaagtaactttctgaatgtgcatttcctgtgtgtggagagataaaaagagaataccttttcactaacttcctgttctgtgattaagagatcctgtcaataaacattttttcctttaattggaaaatctgaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgtt

SEQ ID NO: 4557 - DNA, 3572 bp, Homo sapiens
ccaatacatagcataaaccagcctttatgtgactgagagagagaattgggaagatcagttcattgggatgctaagtacagcctggttggaataagagttagaggtatattgttagagactcaaaaataaatctattatcagaactttcatttgccaagagaggaaatagaaagctattgcaaagtttttagagtgggtgaaaaatgtaaaatgtatgtacataatactgtcattcttacttgcttgtataattttttaaaagacagtgcgaactggtggaagagcagtgattgttcaaacagtaaagatgaactctatcaaaatatgctatccttttttggatggcaagtgtgattgagtagtgaagtaaggtccttggtccttcactctagtatttttaattgatcatctgtgacccaagcggaagtctaccactgagtagaaaatgcaatttccagtggcaattaagtatttctaatgccaacaattcttaaagatctaagccaaattgtgaagttggttaaatcataggctgattataatgcatttatatgttaaagatagtgaaaggaaagctttaaagtgacaaataagagagatattggagtattttttaatgatgaatttaactaacttaacatattttatagtggcattgattttacctatttaatagacacttatttttgaattcccttaaattttctgtttataacctattttcatcttgtaaatgtcaacagaaggacccagtggggtagccaagagaaaaactaaggctaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgtt

SEQ ID NO: 4558 - DNA, 1583 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggcaagtacacattttatgttttttgttagtggtgataaaatgctggaaacaattatttttgctttaataatatctatctcaatagtatatatcttacaggagacttttctcccttaaatcatatatttcattactgttaaaattttaaatggcttatttttccacactctttcatgtcaatttacttttatcaatgaataagtgtatatctcttacacatatatcttttgataagtataataatttcatgtgtgtttccagatttaaagtacttcttattctgaacttagaatttgaatagataatatcctagtctgtttttagatatggtaattatagccatttttcattaacattacacattcacttccatttcaaaatgtaaatttctacaggcttacataaattaatgatgaaataaaagtgataataaacatcttaaaatgtcccatgcatattttaacggtagcattaaaatatgaactcctggtcttttgacccagtgtctttattttggaagtcttggacccttctctttcattatcagaattacttgtctttatcagagatgtttcttgtaataaataacaatgtggtattcccttatttgttttaaagtgctgtcttgctggaaagaatggtgttaatttcaatatgcaaattttatataatctggcctggtgagacttcctttgcttttgtatgtagcataatatatgttaaaactttttatataagagtctttagaaaaataatggatatggcatgatattatacactaagcttataaaataatgacccaaacaaattcttcttagttaacattgttttgtgtatatttattagatatgaaaacatggtaggatgccacatctgtaactagtgaaactgcttttagtagattaattccacctccttatgaaataaagttccaaatatgaaaatagagttttagttgtgattaaaggtaataaaccttcctaatgtt

SEQ ID NO: 4559 - DNA, 1347 bp, Homo sapiens
ggaaggggcgtggccgtcgggcggcgagccgcgcgctctcgccccgggagggagtcacaggttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattagaaggacccagtggggtagccaagagaaaaactaaggctaaaggtattttcattttttcaaattagccttgagtgaatcaagtttaatgtttgaaaatgcatgacattttctgggaatgttaatattgctactaatgctaaacactattgcttttgggtcttgcttgggtgcaacttaggttataagtagttttatcaagatttcatcaaaggattttctgcttcaagcctataattttaagtcattatcttttcatgttatcaaagctttgtaatagtctttaaattaagaatgtatatattatacaaatatgttatatttgttatgatgtatatattaaatttacatgtacacatcttaccttgttccctaaaacctttcttactttgatttttttgaattacttttgggaaaaaaagatgaagtcttcagtaattgtttttatttctccaaaagctctcatgacactctgtcttagagcacagtgaaagctagtgtgattcaaatgtgtagttttcagtaaaatgaaaacttggatgtaaatgtataaccctacattacattgacatagaatttactgtgtttgatattttaattcattaaaaattattgtccgggcacggtggctcacgcctgtaatcccagccctttgggaagctgaggcgggtggatcacgaggtcaggaattcgagactagcctgagcaatatggtgaaaccctgtctcaactgaaaatacaaaaattggctggac

SEQ ID NO: 4560 - DNA, 1495 bp, Homo sapiens
ccaatacatagcataaaccagcctttatgtgactgagagagagaattgggaagatcagttcattgggatgctaagtacagcctggttggaataagagttagaggtatattgttagagactcaaaaataaatctattatcagaactttcatttgccaagagaggaaatagaaagctattgcaaagtttttagagtgggtgaaaaatgtaaaatgtatgtacataatactgtcattcttacttgcttgtataattttttaaaagacagtgcgaactggtggaagagcagtgattgttcaaacagtaaagatgaactctatcaaaatatgctatccttttttggatggcaagtgtgattgagtagtgaagtaaggtccttggtccttcactctagtatttttaattgatcatctgtgacccaagcggaagtctaccactgagtagaaaatgcaatttccagtggcaattaagtatttctaatgccaacaattcttaaagatctaagccaaattgtgaagttggttaaatcataggctgattataatgcatttatatgttaaagatagtgaaaggaaagctttaaagtgacaaataagagagatattggagtattttttaatgatgaatttaactaacttaacatattttatagtggcattgattttacctatttaatagacacttatttttgaattcccttaaattttctgtttataacctattttcatcttgtaaatgtcaacagaaggacccagtggggtagccaagagaaaaactaaggctaaaggtattttcattttttcaaattagccttgagtgaatcaagtttaatgtttgaaaatgcatgacattttctgggaatgttaatattgctactaatgctaaacactattgcttttgggtcttgcttgggtgcaacttaggttataagtagttttatcaagatttcatcaaaggattttctgcttcaagcctataattttaagtcattatcttttcatgttatcaaagctttgtaatagtctttaaattaagaatgtatatattatacaaatatgttatatttgttatgatgtatatattaaatttacatgtacacatcttaccttgttccctaaaacctttcttactttgatttttttgaattacttttgggaaaaaaagatgaagtcttcagtaattgtttttatttctccaaaagctctcatgacactctgtcttagagcacagtgaaagctagtgtgattcaaatgtgtagttttcagtaaaatgaaaacttggatgtaaatgtataaccctacattacattgacatagaatttactgtgtttgatattttaattcattaaaaattattgtccgggcacggtggctcacgcctgtaatcccagccctttgggaagctgaggcgggtggatcacgaggtcaggaattcgagactagcctgagcaatatggtgaaaccctgtctcaactgaaaatacaaaaattggctggac

SEQ ID NO: 4561 - DNA, 429 bp, Homo sapiens
ggccagtctcaagctctggtaggcaagtgcatgcagtgtgcctaaaacctgccagcagtacttttgagttttttttttggtttggttttactttagcatttattattcatggattgaagaaatcaaaatggctgaagataaagaatcaatgtgaaaccagttactgtcttgtactgaagattatttgaaggactgtcagggattctgcctgaaagtttcatcataaatgacttcccaccactcagcttttctgacttcctgggcctgctcttgctgagagatctgtgcactcgataggcttttcctctgtcaccactctgttgctttgactcattgggttagattgtgtctgaaatgtagagttttgtgcatagagctagaaaacttaattgaagttgttagaatcacatctaaaataaaaatgtaaac

SEQ ID NO: 4562 - DNA, 274 bp, Artificial Sequence
  Synthetic oligonucleotide
gttcgtacacgcgaggccgggcgcgcgcagccggcaggcgggtgaagtcttcccaggtgctgcaggcggtgctgaggcacagggtctgctgcaggagcagcggcccgaacccgctccagcggcccgccgccgccagcggctcccgcgtcgcgtgtgtacccccgcgcactgaaggaggtccaccagccctcaccagcccccgcggaccgtgcaatggcccagcgtaagaatgccaagagcagcggcaacagcagcagcagcggctccggcagcg

SEQ ID NO: 4563 - DNA, 143 bp, Artificial Sequence
  Synthetic oligonucleotide
ggccagtctcaagctctggtaggcaagtgcatgcagtgtgcctaaaacctgccagcagtacttttgagttttttttttggtttggttttactttagcatttattattcatggattgaagaaatcaaaatggctgaagataaag

SEQ ID NO: 4564 - DNA, 286 bp, Artificial Sequence
  Synthetic oligonucleotide
aatcaatgtgaaaccagttactgtcttgtactgaagattatttgaaggactgtcagggattctgcctgaaagtttcatcataaatgacttcccaccactcagcttttctgacttcctgggcctgctcttgctgagagatctgtgcactcgataggcttttcctctgtcaccactctgttgctttgactcattgggttagattgtgtctgaaatgtagagttttgtgcatagagctagaaaacttaattgaagttgttagaatcacatctaaaataaaaatgtaaac

SEQ ID NO: 4565 - DNA, 150 bp, Artificial Sequence
  Synthetic oligonucleotide
agacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctag

SEQ ID NO: 4566 - DNA, 271 bp, Artificial Sequence
  Synthetic oligonucleotide
tcaggatgttgttcaatctttaaagataatgctgtgtcagttttatttcatagcatttattagctgaacatttcctgactctcttaactgaattgctcgctatttttaggtaagatattcatttgacactgctttgcaggattaaaagagcaaagaattgtattaattggtaacatttatgactgagttgcatgacttcactaagttataataccttattaaatttcttttcttttttattcccatatccatcatttctgccctattatag

SEQ ID NO: 4567 - DNA, 988 bp, Artificial Sequence
  Synthetic oligonucleotide
gcaagtacacattttatgttttttgttagtggtgataaaatgctggaaacaattatttttgctttaataatatctatctcaatagtatatatcttacaggagacttttctcccttaaatcatatatttcattactgttaaaattttaaatggcttatttttccacactctttcatgtcaatttacttttatcaatgaataagtgtatatctcttacacatatatcttttgataagtataataatttcatgtgtgtttccagatttaaagtacttcttattctgaacttagaatttgaatagataatatcctagtctgtttttagatatggtaattatagccatttttcattaacattacacattcacttccatttcaaaatgtaaatttctacaggcttacataaattaatgatgaaataaaagtgataataaacatcttaaaatgtcccatgcatattttaacggtagcattaaaatatgaactcctggtcttttgacccagtgtctttattttggaagtcttggacccttctctttcattatcagaattacttgtctttatcagagatgtttcttgtaataaataacaatgtggtattcccttatttgttttaaagtgctgtcttgctggaaagaatggtgttaatttcaatatgcaaattttatataatctggcctggtgagacttcctttgcttttgtatgtagcataatatatgttaaaactttttatataagagtctttagaaaaataatggatatggcatgatattatacactaagcttataaaataatgacccaaacaaattcttcttagttaacattgttttgtgtatatttattagatatgaaaacatggtaggatgccacatctgtaactagtgaaactgcttttagtagattaattccacctccttatgaaataaagttccaaatatgaaaatagagttttagttgtgattaaaggtaataaaccttcctaatgtt

SEQ ID NO: 4568 - DNA, 1060 bp, Artificial Sequence
  Synthetic oligonucleotide
gcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttctttactaagctgatattttttattgtaatttgtttaggtttgtcagataggttcatacaaatttctatgtaaaattctgtgttaatggtgcttttaaaataatttaaaaataactccatgtttttgccttagagtaagttaacttactgttttcagatagtagcatgacatatttctgtctgtgaaagcaaaatttattttaaattttatttccaaatatacatccagagaaagtaatttgtattttttttaaagtaggcatattacacaagagggaacatgtgaatatgtatcttaatgttgtacatattaaaattattcatcctaa

SEQ ID NO: 4569 - DNA, 743 bp, Artificial Sequence
  Synthetic oligonucleotide
ccaatacatagcataaaccagcctttatgtgactgagagagagaattgggaagatcagttcattgggatgctaagtacagcctggttggaataagagttagaggtatattgttagagactcaaaaataaatctattatcagaactttcatttgccaagagaggaaatagaaagctattgcaaagtttttagagtgggtgaaaaatgtaaaatgtatgtacataatactgtcattcttacttgcttgtataattttttaaaagacagtgcgaactggtggaagagcagtgattgttcaaacagtaaagatgaactctatcaaaatatgctatccttttttggatggcaagtgtgattgagtagtgaagtaaggtccttggtccttcactctagtatttttaattgatcatctgtgacccaagcggaagtctaccactgagtagaaaatgcaatttccagtggcaattaagtatttctaatgccaacaattcttaaagatctaagccaaattgtgaagttggttaaatcataggctgattataatgcatttatatgttaaagatagtgaaaggaaagctttaaagtgacaaataagagagatattggagtattttttaatgatgaatttaactaacttaacatattttatagtggcattgattttacctatttaatagacacttatttttgaattcccttaaattttctgtttataacctattttcatcttgtaaatgtcaacag

SEQ ID NO: 4570 - DNA, 710 bp, Artificial Sequence
  Synthetic oligonucleotide
gtattttcattttttcaaattagccttgagtgaatcaagtttaatgtttgaaaatgcatgacattttctgggaatgttaatattgctactaatgctaaacactattgcttttgggtcttgcttgggtgcaacttaggttataagtagttttatcaagatttcatcaaaggattttctgcttcaagcctataattttaagtcattatcttttcatgttatcaaagctttgtaatagtctttaaattaagaatgtatatattatacaaatatgttatatttgttatgatgtatatattaaatttacatgtacacatcttaccttgttccctaaaacctttcttactttgatttttttgaattacttttgggaaaaaaagatgaagtcttcagtaattgtttttatttctccaaaagctctcatgacactctgtcttagagcacagtgaaagctagtgtgattcaaatgtgtagttttcagtaaaatgaaaacttggatgtaaatgtataaccctacattacattgacatagaatttactgtgtttgatattttaattcattaaaaattattgtccgggcacggtggctcacgcctgtaatcccagccctttgggaagctgaggcgggtggatcacgaggtcaggaattcgagactagcctgagcaatatggtgaaaccctgtctcaactgaaaatacaaaaattggctggac

SEQ ID NO: 4571 - DNA, 1030 bp, Artificial Sequence
  Synthetic oligonucleotide
tagaaagacatagtgcttttagtgagcactgcaaatctaatgctcattttgaataccatttgtgctatgtaagttttatgtgattttgatgggcaaaaacatctttcacattttattatattaaagaaatatttcattttctttgtttctgcttaaatgtggcattgcttctgcttaaatgtggcattgcaaacaccttaccttatgatttccttatgagagtacaaacagatgaaattcagagcttttgctaactgctttattaccatgtaaagcaagttgaaagcaataccttccatgagatttggaattagctgtgtgtttcatttaattgctctctcaacccaatgaactagaagacgtgtgttagcttgagttgctctacatgaattaacagggaaacatacttaaaggaatactgatttcatgatgaatataagcagaaagagaattctaatttttccttttaaatactacagataatgatttaaaaatgtcatacacatgacaattttttcctagttaactaataaaatgaaattatatttaattttatttacatatatttgtcttcaaagaagcacgtgtattttaaggacatatgtttttgagctaaacattttaaattatctttgtatatattcttacaaattatgaaaaatttgttcttacgttgccagtgttcctttaattatagttacaaagtgtgagttaatactttgtgtaaagcactgccttcgtggtgccctcaattttataatattgcatgttaatgttttaagacaagtcatactatatttcaagatggaaaatatgacaagcttctagcattttttaatagttgatatttgatagagatttgcacctatttttagccaccataaagactagtgaattaaagtaactttctgaatgtgcatttcctgtgtgtggagagataaaaagagaataccttttcactaacttcctgttctgtgattaagagatcctgtcaataaacattttttcctttaattggaaaatctgaaag

SEQ ID NO: 4572 - DNA, 3041 bp, Artificial Sequence
  Synthetic oligonucleotide
aactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcctctcaccctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttggagttttatgttttgattagtcaggattttgccatttttacacattacaagaacattgtaaaccaaaaagggaattctacagctgctttgtttggcagatacagggcactaacttcagatgactagatcccaagtctagacctggaatcagagttctttttcctcttagctcacttcctaagtcttaactgtgctggtttctgcctgagttattctatttggagatgctaccacttgataaccaagatggccctcagcaggctccagaccagtctctagtttaccaatcccaatgcagatggctctgggagagataattccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgttttggctatctcattgatttttcctttgactgttagctcaagaattgaaacacctcaactaaaacatttaaagatcctttaaaagcacttgtagactagaacttgatttattttttcccatctctcttcttttccccttctcttttctttctttttgtaaatgtttcaactaacttttattgaagttgaagtcacactttatccaactgcgtaatatttaagcttcaactaaaaacaagctttcagtcatgattagagggt

SEQ ID NO: 4573 - DNA, 3204 bp, Artificial Sequence
  Synthetic oligonucleotide
gtaatttgcattgtatatagatgatcgtctcaaaatttcacaatgagagactgatgaaattgacataaatcaatcagcatgaacacttgaattaatccagaggactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaatgcttaatttttaaaagaatattgtgacaacctgaaaacacaagatatgaaggctagaaaaaaagttatgaaataaactatagccttaagtatatggtacaatcgagaagcctaataaccagcctaattgtgaaaaacttatgtttgttttgtattcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagcccaggagtagttttggcttttttcttttgttatgctggatctaggtgcttgaacagtgttctcaacatccatctgtctatggaccctcaggaatgttggctttcttctcgggcagagtctcgtgtgctcatcttcaaccctactccttatggggtgggagataagaaagctgtgattggtgacaccctgggatatgtgagtgcccacttttaaactgttgggtaaagaaaaattggagtcctctaaggaagttagtgtgtttttaccagaaggaggaggaattgatgcactgaaagcaggcagatgatggagtttgtttcccctttttctacccatcccattcctacttctccccctgcccaaatacagagaggtgaatgggatgggccaaaataggtatttcaaaataagaagctgtggagctaaacattgggtactcatgggcataaagatggaaacaggagacactagaacttctagagaggggagagagggagggagacaagggttgaaaaactaactattggatactatgctcattacctgagtgatggaatcattcatattctaaatttcaatatcacgcaatatacccatgcagcaaacttgcacgtgctccttgaatctaaatagaagttgaagttatatttaaaaattaaaaaaaaaaaagctagggagaagagagagatctcattccaaacaattattggtcaacaatagttttagaccattgaaagaatataagagaatgttgacttgataataaatattgccatttagatgtcaggtgataaagtttattttgttgttaagctctctccattttgccccattcagtttaaaaggaaagtttttgtgtttaggaaactaaaggatgggtgatatgtagcagacccataaggttattttcatgaaaaacctagcttgggctaatctgaaagattcctcaataacagtctttggtgtcttatcctttcttctccatttgcctaagaatataattgtataagctggatgtttattccttggctatcgtttttacctaggaatcaatttctgcaagagctctgtaagccttacaaagcagaaagtcatccatttcttttttctttgttctcatttagtgcctcatttgatttcactttgtgtatctatttattgctccatgttaagtcaggtatgcatacatcatagaagtctgcctctcatttccatcttctttgccttatgtatcacttctcttgtgtcctattagagggagatgatctatgcttaaagctgttgggttatttttgataattatataacaccaacatgctgtgtctatagttcccatttattgattcaactaatatttctgagtatctacagcatgccgggactgggcaaggcatgggggatacaagagattgaggtggctgcaatccctccagtgaaatgctgcaaaataagcaaggggctgagagagaaagtaatgagactgaaacgattgtcagtacagcccactagtccctctgcctagaacgtgctcctgaatgtgctcctgctctgtgtggtgggctgcctttgtctctcccacgggacccagcccagtcatcacctctgcactcagacatctctgaccctcccaagtggctgcatcccacacactccagttatcgcactcatcaccttgcctcattcttggactttgctgccagactacgatttatctcgagcacctatcctagtaactgacactaataggcattcattgtttgtttattgaatggtgactatacaaaataaattatctaaaaatatttcaggtgtatatatactgttgaagaatattaggaagaagaaaaccgtgtgtgtgtgtttttgaagaacccaaaagattgttcagtaattgcagtgttttaactaccttggaagtta

SEQ ID NO: 4574 - DNA, 129 bp, Artificial Sequence
  Synthetic oligonucleotide
ttgagggagaagacttgcaacaagaagatggacccacaggagaaccacaacaagaggatgatgagtttcttatggcgactgatgtagatgatagatttgagaccctggaacctgaagtatctcatgaag

SEQ ID NO: 4575 - DNA, 568 bp, Artificial Sequence
  Synthetic oligonucleotide
atacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacat

SEQ ID NO: 4576 - DNA, 334 bp, Artificial Sequence
  Synthetic oligonucleotide
ttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaag

SEQ ID NO: 4577 - DNA, 1516 bp, Artificial Sequence
  Synthetic oligonucleotide
tgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagcaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctatattgtcattatttttgaagtataaggtatttttaatttgttacataataaaatcagttcattttatccttactagtattttagaagattatagcatttttgataactaaaatcacaaaggaataccttcagccagttaacgtatttctaacagataatgcttattttgcatttactatcatgctacattgccaggaagcaagattaaaattaaatagcccctgcagccatcctttgtagattttgtcctgcacctagaagttttgattattccctggacagcctgctccaccttttttccccaaatttttaatttttgtgagtatataatagatgtataaatttgactatatgagatatttcgatacagatatagaaaatgtacaataaattattgttggctatagtaactctgttttgctatcaaatactagatcttattcattgtatataactatatttttgtacccattaaccatcttcacctcctgctcccctctcccctcactacccttcccaacctctggtaaccatccttctaccctctacctctgtgagttcaattgttttaatttttagcacccacaaattagtgagaacatgtgatgtttatctttctgtgcctggcttatttcacctaacataatgacctccagttccatccatgttgtttcaaatggcaggatcttattcttttttatggctgagtagtactccattatatatgtaccacattttcttcattcgtctgttgacagacccttaagttgattccaaagcttagctattgtaaatagtgcaataaacatgagagtgcgtaaatttc

SEQ ID NO: 4578 - DNA, 872 bp, Artificial Sequence
  Synthetic oligonucleotide
aggactcatttgcgtctggtgaaagccaggcggcttgcaccatgtcctgggacttcagccatcctttcatgtgttgacccttcttaaagaatggaagggggaactgaataaagaagataacagcttctagctaagaaggatgatgcattagtttgccaaatatataggctccttttgtgtgctatgctctgtggagcgctctgaaagcaaagcaagtaactacaatgtaaagaggtagagactatgaacaaaatgctgtgggaacaccaaggaggaaatgacacactgctggcaggagatggaaagcaactggagtcttcatggagcgatgacatttgagctggtcctcaagtagtgggtgaggattacatccatgcaagagccctgtgaacccagatactgaagtatgtctaatgacaaggatgataagttgatatggaaaaaaatatcacaggtgtttctgctcacagcaagcccagcagtactccaagagcagtacttaacttgggtgtcatgggctatgctctctatacagaagattacattagagtcttgtcttaaaaaccctttttgggaaaattatcataattcatttttttctaatatccaatgacttttacgcttttgctactttgattcatcagtacgttgatgataccttctcctctttgtcccattcctgcttcatgataatttaatgaaattaaagtaatggatttaattagcacctacatctatgattatatgtatatattatttatctgaaacctttggggtgggccagctaccacaattaaaatatcaacttgattcaagttgtgtgaagcacactttaaacttgaaataaaagtgaataaaatctatttatacag

SEQ ID NO: 4579 - DNA, 537 bp, Artificial Sequence
  Synthetic oligonucleotide
agcctccacccaggctgaagtgcagtggcacagtctcggctaactggaacctctgcttcctgagtttaagcagttctcctcctgagtagctgggattacagatgctcaccaccatgcctggctaatttttgtatttttagtagagacagggtttcaccatgttgcccaggctggtcttgaactcctgacctcaagtgatccacccgtctcagcctccgaaagtgctgggattacaggcgtgagccataagtgagattaaaataataataataataataataataacactgtcaagtatcatagaagtgcaagtttttaattttatagctccttgatgcaaaaagaaaaactaggtcagtccattactcaggatagtaattggtagatgaaatgacattcttcttacttagggttaacctcatgcacctccagttttcagggtaccttatttatattttaatttgtcgatatatttgaaatattacttgcatttctttatagatattacaattttgagaacaataaattgaaactgga

SEQ ID NO: 4580 - DNA, 151 bp, Artificial Sequence
  Synthetic oligonucleotide
tgtgaggatgatttggctgagaagaggagaagtaatgaggtgctacgtggagccatcgagacctaccaagaggtggccagcctacctgatgtccctgcagacctgctgaagctgagtttgaagcgtcgctcagacaggcaacaatttctag

SEQ ID NO: 4581 - DNA, 137 bp, Artificial Sequence
  Synthetic oligonucleotide
gtcatatgagaggttccctgcttaccctgcagagattagttcaactatttcccaatgatacttccttaaaaaatgaccttggcgtgggatacctcttgataggagataatgacaatgcaaagaaagtttatgaagag

SEQ ID NO: 4582 - DNA, 138 bp, Artificial Sequence
  Synthetic oligonucleotide
gcatataagtggtatgagcttgggcacaagagaggacactttgcatctgtctggcaacgctcactctacaatgtgaatggactgaaagcacagccttggtggaccccaaaagaaacgggctacacagagttagtaaag

SEQ ID NO: 4583 - DNA, 136 bp, Artificial Sequence
  Synthetic oligonucleotide
tctttagaaagaaactggaagttaatccgagatgaaggccttgcagtgatggataaagccaaaggtctcttcctgcctgaggatgaaaacctgagggaaaaaggggactggagccagttcacgctgtggcagcaag

SEQ ID NO: 4584 - DNA, 134 bp, Artificial Sequence
  Synthetic oligonucleotide
atcaaatattccatcatgcaccccgggactcacgtgtggccgcacacagggcccacaaactgcaggctccgaatgcacctgggcttggtgattcccaaggaaggctgcaagattcgatgtgccaacgagaccaa

SEQ ID NO: 4585 - DNA, 515 bp, Artificial Sequence
  Synthetic oligonucleotide
gtatgggtcctctgttatccgtcatatccgtcacctcagaggatgagagtttgttacaacacagttgtgttcctttggattacttatcttcttttgtagctgaagtagactggagcaaagtgatattaatccaaactcttaagtctatatcccttcttggtgctttctattagcctggagacattgcccagctctagggctgccctcctccattatttctcggcagagtacttatctagttgaggagctgccttgtttctctctctgggtagacagatgtgcattcagagtcagccaacatgcattgagccctgcagatgttatgcattgtgcttcctgctttgcaacttgacttattcatgactacaagaagtacccctaactgaagaactcaccccatgatatttatacgttttgatatagaggagatggtatggtgcaatggaagctggctgcctttttcaaatcccagctctaacacctaacctgtgtaaccttggctagttacttaatcc

SEQ ID NO: 4586 - DNA, 60 bp, Artificial Sequence
  Synthetic oligonucleotide
ggaaggggcgtggccgtcgggcggcgagccgcgcgctctcgccccgggagggagtcacag

SEQ ID NO: 4587 - DNA, 42 bp, Artificial Sequence
  Synthetic oligonucleotide
gtagcacgagtgcgggcagcagcagccccggggcccggagag

SEQ ID NO: 4588 - DNA, 45 bp, Artificial Sequence
  Synthetic oligonucleotide
ccaaagcaaaggacttccgttataacttatcagaggtgcttcaag

SEQ ID NO: 4589 - DNA, 69 bp, Artificial Sequence
  Synthetic oligonucleotide
gaaaactaggaatctatgatgctgatggtgatggagattttgatgtggatgatgccaaagttttattag

SEQ ID NO: 4590 - DNA, 42 bp, Artificial Sequence
  Synthetic oligonucleotide
aaggacccagtggggtagccaagagaaaaactaaggctaaag

SEQ ID NO: 4591 - DNA, 6 bp, Artificial Sequence
  Synthetic oligonucleotide
ttaaag

SEQ ID NO: 4592 - DNA, 93 bp, Artificial Sequence
  Synthetic oligonucleotide
gacttaaagagagatctacttcagagccagcagtcccgccagaagaggctgagccacacactgagcccgaggagcaggttcctgtggaggcag

SEQ ID NO: 4593 - DNA, 75 bp, Artificial Sequence
  Synthetic oligonucleotide
aaccccagaatatcgaagatgaagcaaaagaacaaattcagtcccttctccatgaaatggtacacgcagaacatg

SEQ ID NO: 4594 - DNA, 33 bp, Artificial Sequence
  Synthetic oligonucleotide
aaaccgagcatagttaccacgtggaagagacag

SEQ ID NO: 4595 - DNA, 57 bp, Artificial Sequence
  Synthetic oligonucleotide
tttcacaagactgtaatcaggatatggaagagatgatgtctgagcaggaaaatccag

SEQ ID NO: 4596 - DNA, 48 bp, Artificial Sequence
  Synthetic oligonucleotide
attccagtgaaccagtagtagaagatgaaagattgcaccatgatacag

SEQ ID NO: 4597 - DNA, 33 bp, Artificial Sequence
  Synthetic oligonucleotide
atgatgtaacataccaagtctatgaggaacaag

SEQ ID NO: 4598 - DNA, 42 bp, Artificial Sequence
  Synthetic oligonucleotide
cagtatatgaacctctagaaaatgaagggatagaaatcacag

SEQ ID NO: 4599 - DNA, 44 bp, Artificial Sequence
  Synthetic oligonucleotide
aagtaactgctccccctgaggataatcctgtagaagattcacag

SEQ ID NO: 4600 - DNA, 13 bp, Artificial Sequence
  Synthetic oligonucleotide
gtaattgtagaag

SEQ ID NO: 4601 - DNA, 45 bp, Artificial Sequence
  Synthetic oligonucleotide
aagtaagcatttttcctgtggaagaacagcaggaagtaccaccag

SEQ ID NO: 4602 - DNA, 25 bp, Artificial Sequence
  Synthetic oligonucleotide
tagctttaagtgttcagattaacac

SEQ ID NO: 4603 - DNA, 32 bp, Artificial Sequence
  Synthetic oligonucleotide
ttttgaaatttttgtagcttttagctgattaa

SEQ ID NO: 4604 - DNA, 16 bp, Artificial Sequence
  Synthetic oligonucleotide
ttagaaaaattaatat

SEQ ID NO: 4605 - DNA, 80 bp, Artificial Sequence
  Synthetic oligonucleotide
ctcacagagcccgatgcctgctgctatttcacggcaatgagcctttttctttctacactgaagattttcttcttatttaa

SEQ ID NO: 4606 - DNA, 42 bp, Artificial Sequence
  Synthetic oligonucleotide
aaacaaatagaaaaacagatgatccagaacaaaaagcaaaag

SEQ ID NO: 4607 - DNA, 86 bp, Artificial Sequence
  Synthetic oligonucleotide
ttaagaaaaagaagcctaaacttttaaataaatttgataagactattaaagctgaacttgatgctgcagaaaaactccgtaaaagg

SEQ ID NO: 4608 - DNA, 87 bp, Artificial Sequence
  Synthetic oligonucleotide
ggaaaaattgaggaagcagtgaatgcatttaaagaactagtacgcaaataccctcagagtccacgagcaagatatgggaaggcgcag

SEQ ID NO: 4609 - DNA, 76 bp, Artificial Sequence
  Synthetic oligonucleotide
gtgctgagtgtgacacctaatgatggctttgctaaagtccattatggcttcatcctgaaggcacagaacaaaattg

SEQ ID NO: 4610 - DNA, 23 bp, Artificial Sequence
  Synthetic oligonucleotide
ctgagagcatcccatatttaaag

SEQ ID NO: 4611 - DNA, 90 bp, Artificial Sequence
  Synthetic oligonucleotide
gaaggaatagaatccggagatcctggcactgatgatgggagattttatttccacctgggggatgccatgcagagggttgggaacaaagag

SEQ ID NO: 4612 - DNA, 63 bp, Artificial Sequence
  Synthetic oligonucleotide
gaagaagaaatgaaaatgcctgcaaaggagctcctaaaacctgtaccttactagaaaagttcc

SEQ ID NO: 4613 - DNA, 19 bp, Artificial Sequence
  Synthetic oligonucleotide
ccgagacaacaggatgcag

SEQ ID NO: 4614 - DNA, 10 bp, Artificial Sequence
  Synthetic oligonucleotide
aagaggacag

SEQ ID NO: 4615 - DNA, 3595 bp, Homo sapiens
agtaggcaagcggggactggcatctaggcaggagggaggcgcacctgcaggtgcaggtggctctgaacccattcctgatggctctctaggcctctgcacctccagtcccatccctgtgggcgagtgctgcctacacctggtgtcacccagcaatgggtgagccctggggatagccagctctgcattcaaggggttaggtttccagggtaaccgagcccctgagcccagcgtggagcctggcagagccagtaatctgactcccctttccctcccgccaggggctgtccagaggctccgctttgcctcagcctttagccccagagaggcagggtgtggagggtgggggctggcttcttgggtaagagatgcctcagggaagatctacctggctccctgctccttaaacctttccctcctgcccaggtccaccccttcctcttccctggtcacttggcacttcgacctcctgcccgtttcggaaaggggtgtgccctgaggtgactgaactttgcctgatcatgaccttgatcatgcacagggctgctggtggggtgaggccatcccacgcaactctggggtctgtgaagccaccaaggatcaaggaatggaagagctgcctgagtgtagagggagttcggtcaggcttcttaaacttggagacttggaaacagaaggccttgtaggccacataggttttcagagactcgcctggcagaggcctggagcgtcctgctgcgtggactgtgggcaccgagccaccaggaggttgttgatctcattcttgctcactggtccctgccagactggtggtgcctctctactgtcgggcagccccacctctgtgctgccccatccacctacagccctcatgcctgggcccagctggaggttctgacaggggccccctggggtggcatgcggacccttcagggtgccccaggcgcagcacaggtctccagagacacaggcaccagggcgttcagagctagtcccctcgctgctgttgactgtccttgagcagccccagggccggtttctcaacctcatttgctcacctgagcaatgaagtgaggtgggctcctggaactgcagcagccaccccccggggccatcgtgaggctaagaatccagtgcagggtgagcaaccagcgaccgctacaaggacagtgaagagctagcaccaggaccttgggtagcccacccgctggagggagcgtgtgctgcaaaaagcaagagtgggctttggaggccaacggatggagcggattcagtctgaggctgttccagcccttgcttaggatccacctacctaggtctggaaatcgtatttccacttcagatgccttctcagaggataaaataacccccggtgggggagagtactggaagagggctaattcccctggttttctccccatgagcattagtgtcagtgtaattttagagtgaccccagctatgtcacgtgtggcaggcacaagaacagatgtcaatgagctattgcagaggtggacacccagatgtgtgcgctggcacactggaggggcccgtagggtggctctagaccgccccctcgtgacggcttgcctaccacctgcaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4616 - DNA, 2719 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtactagttactcccccataccctcagcaacccgcctgcctgtgctgagaacccatctactggtgtttgagtccagggtgtttccctgcagtgccctgaattctccatgggaggacccgtgcatgggggtggggggacagaagctgcccacccagcggcttctctgcggagccacaatggaggtggaggggtctgaacttctgaggccccgccccggcccacaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4617 - DNA, 2831 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggtcagtgccagcaccatgggtctgcgatgggggcggggctgggtggcccccagggtgtaggcttcaccggcaagttatcctcacgttcttcagtttccgcatctgaagtgggcctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagctcacaggcctgcctggctgcaggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4618 - DNA, 2690 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcggtgagcaagagctggcgggactggcaggggcagggccaaggggcaggcagcctccaccccaaactgtgtccctgtccttgcatctgctcacatagagcactgtcagctgtgggagggccctggtagtccccaggagaggccgtgttgaggaaggagggctaagccgagccctggggtgttgcccaccctccacagaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4619 - DNA, 2812 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtgtgcccctccccttacctgacggtgcctttcagtcccacctgcctctgccatcctctctcccagtcccactgtgtccactgtgagcctttgcccaggtgggccctgcctggtgtgcgtgctacagccccacctggcctgttctcattgcctgtgcatcagacatgtctgccctcatcacctgtctgcctccctgccccgttatgcccacacctgcctgaagcctgcccctgggtttgctgtgggactcgggggccgctgcagggagaaaggaagtaggcagagcagcactgcccactcaggcccctccccaccaggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4620 - DNA, 2909 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggtcagtgccagcaccatgggtctgcgatgggggcggggctgggtggcccccagggtgtaggcttcaccggcaagttatcctcacgttcttcagtttccgcatctgaagtgggcctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagctcacaggcctgcctggctgcaggttcttcttccgcagtgggaacatcgagcacccggaggacaagctcttcaacacgtctgtggaggtgctgcccttcgacgtaagttcggtgggtgtggtgtgcactgaagccgggcctcctgtgaccacctgcctcagcccttgattctgcccccagaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4621 - DNA, 2771 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcggtgagcaagagctggcgggactggcaggggcagggccaaggggcaggcagcctccaccccaaactgtgtccctgtccttgcatctgctcacatagagcactgtcagctgtgggagggccctggtagtccccaggagaggccgtgttgaggaaggagggctaagccgagccctggggtgttgcccaccctccacagaagcactgtgaccggcagaaagccaacctgcggatccgcttcaaaccgtccctcttccagcacgtgggcactcactcctcgctggctggcaagatccagaaactgaaggtgggctgcactgcacgctctccctaggccgggatcaaggtcggggcccacgccatcactgctgtccctcctccgctgcaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4622 - DNA, 3036 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtactagttactcccccataccctcagcaacccgcctgcctgtgctgagaacccatctactggtgtttgagtccagggtgtttccctgcagtgccctgaattctccatgggaggacccgtgcatgggggtggggggacagaagctgcccacccagcggcttctctgcggagccacaatggaggtggaggggtctgaacttctgaggccccgccccggcccacaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtgtgcccctccccttacctgacggtgcctttcagtcccacctgcctctgccatcctctctcccagtcccactgtgtccactgtgagcctttgcccaggtgggccctgcctggtgtgcgtgctacagccccacctggcctgttctcattgcctgtgcatcagacatgtctgccctcatcacctgtctgcctccctgccccgttatgcccacacctgcctgaagcctgcccctgggtttgctgtgggactcgggggccgctgcagggagaaaggaagtaggcagagcagcactgcccactcaggcccctccccaccaggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4623 - DNA, 3150 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtactagttactcccccataccctcagcaacccgcctgcctgtgctgagaacccatctactggtgtttgagtccagggtgtttccctgcagtgccctgaattctccatgggaggacccgtgcatgggggtggggggacagaagctgcccacccagcggcttctctgcggagccacaatggaggtggaggggtctgaacttctgaggccccgccccggcccacaggtggaggaccaaacagaacctcgattactgcttcctcatgatgtacgcgcagtccaaaggcatctactacgtgcaggtcagccccaagccctgcgttgccctgccctgccctgcgccgccctgccctgcgatgggtctggtccatctgggtgcccttcctcagccccagcccctctctgctcacctcgcgctggaggatgacatcgtggccaagcccaactacctgagcaccatgaagaactttgcactgcagcagccttcagaggactggatgatcctggagttctcccagctgggcttcattggtgtgcccctccccttacctgacggtgcctttcagtcccacctgcctctgccatcctctctcccagtcccactgtgtccactgtgagcctttgcccaggtgggccctgcctggtgtgcgtgctacagccccacctggcctgttctcattgcctgtgcatcagacatgtctgccctcatcacctgtctgcctccctgccccgttatgcccacacctgcctgaagcctgcccctgggtttgctgtgggactcgggggccgctgcagggagaaaggaagtaggcagagcagcactgcccactcaggcccctccccaccaggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4624 - DNA, 2990 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggtgggctgcactgcacgctctccctaggccgggatcaaggtcggggcccacgccatcactgctgtccctcctccgctgcaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggtcagtgccagcaccatgggtctgcgatgggggcggggctgggtggcccccagggtgtaggcttcaccggcaagttatcctcacgttcttcagtttccgcatctgaagtgggcctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagctcacaggcctgcctggctgcaggttcttcttccgcagtgggaacatcgagcacccggaggacaagctcttcaacacgtctgtggaggtgctgcccttcgacgtaagttcggtgggtgtggtgtgcactgaagccgggcctcctgtgaccacctgcctcagcccttgattctgcccccagaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4625 - DNA, 2686 bp, Homo sapiens
gccgtcgactccgcggcggccccagatccaggccccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacccggggccggggcccctgccgccgccgccgccgccttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcgctgtcctggtacgcggcactcagcggccagaaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtgtgcccctccccttacctgacggtgcctttcagtcccacctgcctctgccatcctctctcccagtcccactgtgtccactgtgagcctttgcccaggtgggccctgcctggtgtgcgtgctacagccccacctggcctgttctcattgcctgtgcatcagacatgtctgccctcatcacctgtctgcctccctgccccgttatgcccacacctgcctgaagcctgcccctgggtttgctgtgggactcgggggccgctgcagggagaaaggaagtaggcagagcagcactgcccactcaggcccctccccaccaggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctgaggcccggaaccgttcgcacccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctca

SEQ ID NO: 4626 - DNA, 187 bp, Artificial Sequence
  Synthetic oligonucleotide
ccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccg

SEQ ID NO: 4627 - DNA, 144 bp, Artificial Sequence
  Synthetic oligonucleotide
cttccgacccctgcgccccggccccggtcccccgggccatgcagcctcggccccgcgggcgcccgccgcgcacccgaggagatgaggctccgcaatggcaccttcctgacgctgctgctcttctgcctgtgcgccttcctctcg

SEQ ID NO: 4628 - DNA, 765 bp, Artificial Sequence
  Synthetic oligonucleotide
agtaggcaagcggggactggcatctaggcaggagggaggcgcacctgcaggtgcaggtggctctgaacccattcctgatggctctctaggcctctgcacctccagtcccatccctgtgggcgagtgctgcctacacctggtgtcacccagcaatgggtgagccctggggatagccagctctgcattcaaggggttaggtttccagggtaaccgagcccctgagcccagcgtggagcctggcagagccagtaatctgactcccctttccctcccgccaggggctgtccagaggctccgctttgcctcagcctttagccccagagaggcagggtgtggagggtgggggctggcttcttgggtaagagatgcctcagggaagatctacctggctccctgctccttaaacctttccctcctgcccaggtccaccccttcctcttccctggtcacttggcacttcgacctcctgcccgtttcggaaaggggtgtgccctgaggtgactgaactttgcctgatcatgaccttgatcatgcacagggctgctggtggggtgaggccatcccacgcaactctggggtctgtgaagccaccaaggatcaaggaatggaagagctgcctgagtgtagagggagttcggtcaggcttcttaaacttggagacttggaaacagaaggccttgtaggccacataggttttcagagactcgcctggcagaggcctggagcgtcctgctgcgtggactgtgggcaccgagccaccaggag

SEQ ID NO: 4629 - DNA, 834 bp, Artificial Sequence
  Synthetic oligonucleotide
gttgttgatctcattcttgctcactggtccctgccagactggtggtgcctctctactgtcgggcagccccacctctgtgctgccccatccacctacagccctcatgcctgggcccagctggaggttctgacaggggccccctggggtggcatgcggacccttcagggtgccccaggcgcagcacaggtctccagagacacaggcaccagggcgttcagagctagtcccctcgctgctgttgactgtccttgagcagccccagggccggtttctcaacctcatttgctcacctgagcaatgaagtgaggtgggctcctggaactgcagcagccaccccccggggccatcgtgaggctaagaatccagtgcagggtgagcaaccagcgaccgctacaaggacagtgaagagctagcaccaggaccttgggtagcccacccgctggagggagcgtgtgctgcaaaaagcaagagtgggctttggaggccaacggatggagcggattcagtctgaggctgttccagcccttgcttaggatccacctacctaggtctggaaatcgtatttccacttcagatgccttctcagaggataaaataacccccggtgggggagagtactggaagagggctaattcccctggttttctccccatgagcattagtgtcagtgtaattttagagtgaccccagctatgtcacgtgtggcaggcacaagaacagatgtcaatgagctattgcagaggtggacacccagatgtgtgcgctggcacactggaggggcccgtagggtggctctagaccgccccctcgtgacggcttgcctaccacctgcag

SEQ ID NO: 4630 - DNA, 186 bp, Artificial Sequence
  Synthetic oligonucleotide
gcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacag

SEQ ID NO: 4631 - DNA, 224 bp, Artificial Sequence
  Synthetic oligonucleotide
gtactagttactcccccataccctcagcaacccgcctgcctgtgctgagaacccatctactggtgtttgagtccagggtgtttccctgcagtgccctgaattctccatgggaggacccgtgcatgggggtggggggacagaagctgcccacccagcggcttctctgcggagccacaatggaggtggaggggtctgaacttctgaggccccgccccggcccacag

SEQ ID NO: 4632 - DNA, 317 bp, Artificial Sequence
  Synthetic oligonucleotide
gtgtgcccctccccttacctgacggtgcctttcagtcccacctgcctctgccatcctctctcccagtcccactgtgtccactgtgagcctttgcccaggtgggccctgcctggtgtgcgtgctacagccccacctggcctgttctcattgcctgtgcatcagacatgtctgccctcatcacctgtctgcctccctgccccgttatgcccacacctgcctgaagcctgcccctgggtttgctgtgggactcgggggccgctgcagggagaaaggaagtaggcagagcagcactgcccactcaggcccctccccaccag

SEQ ID NO: 4633 - DNA, 131 bp, Artificial Sequence
  Synthetic oligonucleotide
gtaagatgttcaagtcgctggacctgagcctgattgtagagttcattctcatgttctaccgggacaagcccatcgactggctcctggaccatattctgtgggtgaaagtctgcaaccccgagaaggatgcg

SEQ ID NO: 4634 - DNA, 195 bp, Artificial Sequence
  Synthetic oligonucleotide
gtgagcaagagctggcgggactggcaggggcagggccaaggggcaggcagcctccaccccaaactgtgtccctgtccttgcatctgctcacatagagcactgtcagctgtgggagggccctggtagtccccaggagaggccgtgttgaggaaggagggctaagccgagccctggggtgttgcccaccctccacag

SEQ ID NO: 4635 - DNA, 137 bp, Artificial Sequence
  Synthetic oligonucleotide
gtgagcacgagcctgaagacataccagcacttcaccctggagaaagcctacctgcgcgaggacttcttctgggccttcacccctgccgcgggggacttcatccgcttccgcttcttccaacctctaagactggagcg

SEQ ID NO: 4636 - DNA, 336 bp, Artificial Sequence
  Synthetic oligonucleotide
gtcagtgccagcaccatgggtctgcgatgggggcggggctgggtggcccccagggtgtaggcttcaccggcaagttatcctcacgttcttcagtttccgcatctgaagtgggcctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagctcacaggcctgcctggctgcag

SEQ ID NO: 4637 - DNA, 170 bp, Artificial Sequence
  Synthetic oligonucleotide
atcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccg

SEQ ID NO: 4638 - DNA, 907 bp, Artificial Sequence
  Synthetic oligonucleotide
ccggcctgccccagtcaggccgttttagaagagcttttacttgggcgcccgccgtctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaatgtgagcgccctgggcatctccctctgccctgcggttggcttcatttggtctgtgccccaacatgccaactaagcctggcactgggcctccccagccagcatcagcagcgacctttccctgctaagtcaaggagccagcctggcctgcaggcgcggggtccagcccctggctgtgcagctgcagtgccacctcggcgccagcgtaccccccttcctaggatcaggccgcaaagtctgtcactggtgaaaccagctcagaatctgggaccacaatgcctatagcaggtcccccgaatgtctcccccatgtccaaggcctgcgatgaggccttcccttagctcctcaagctgaaggcatttcccagcctccttgttcccctccgtgtgtctcagcttggtcctcatcctgggtccccgacactcctctggcacattagggtctcccgctcacctcagggcctttgcacacactgttgcccctccttggaaagctctcctttctccgtttctcctgcatacttggctaaaagtcacttctttgtttctgtgggcctcccctggatccccaaggcttctggacatttccttgagaccgcctgtcactgactcacttcgttcccatggtgcccgcagctctgcggacctcggagggctgccctgaacacctacagttaacgagggggatccagtgctgaccaaaagaaaaa

SEQ ID NO: 4639 - DNA, 62 bp, Artificial Sequence
  Synthetic oligonucleotide
gccgtcgactccgcggcggccccagatccaggccccagatccaggccgggccgcggctctcg

SEQ ID NO: 4640 - DNA, 47 bp, Artificial Sequence
  Synthetic oligonucleotide
gtccccgcccggccccgggccccccgcccctccccgacccggggccg

SEQ ID NO: 4641 - DNA, 18 bp, Artificial Sequence
  Synthetic oligonucleotide
gggcccctgccgccgccg

SEQ ID NO: 4642 - DNA, 7 bp, Artificial Sequence
  Synthetic oligonucleotide
ccgccgc

SEQ ID NO: 4643 - DNA, 34 bp, Artificial Sequence
  Synthetic oligonucleotide
ctgtcctggtacgcggcactcagcggccagaaag

SEQ ID NO: 4644 - DNA, 41 bp, Artificial Sequence
  Synthetic oligonucleotide
aggacccccgattgaagccgtggaacggctcacaccggcac

SEQ ID NO: 4645 - DNA, 9 bp, Artificial Sequence
  Synthetic oligonucleotide
gtgctgcac

SEQ ID NO: 4646 - DNA, 21 bp, Artificial Sequence
  Synthetic oligonucleotide
ctgcccaccgtcttccatcac

SEQ ID NO: 4647 - DNA, 70 bp, Artificial Sequence
  Synthetic oligonucleotide
ctgccacacctgctggccaaggagagcagtctgcagcccgcggtgcgcgtgggccagggccgcaccggag

SEQ ID NO: 4648 - DNA, 26 bp, Artificial Sequence
  Synthetic oligonucleotide
tgtcggtggtgatgggcatcccgagc

SEQ ID NO: 4649 - DNA, 57 bp, Artificial Sequence
  Synthetic oligonucleotide
gtgcggcgcgaggtgcactcgtacctgactgacactctgcactcgctcatctccgag

SEQ ID NO: 4650 - DNA, 12 bp, Artificial Sequence
  Synthetic oligonucleotide
ctgagcccgcag

SEQ ID NO: 4651 - DNA, 39 bp, Artificial Sequence
  Synthetic oligonucleotide
gagaaggaggactcggtcatcgtggtgctgatcgccgag

SEQ ID NO: 4652 - DNA, 47 bp, Artificial Sequence
  Synthetic oligonucleotide
actgactcacagtacacttcggcagtgacagagaacatcaaggcctt

SEQ ID NO: 4653 - DNA, 114 bp, Artificial Sequence
  Synthetic oligonucleotide
gttccccacggagatccattctgggctcctggaggtcatctcaccctccccccacttctaccctgacttctcccgcctccgagagtcctttggggaccccaaggagagagtcag

SEQ ID NO: 4654 - DNA, 76 bp, Artificial Sequence
  Synthetic oligonucleotide
gtggaggaccaaacagaacctcgattactgcttcctcatgatgtacgcgcagtccaaaggcatctactacgtgcag

SEQ ID NO: 4655 - DNA, 114 bp, Artificial Sequence
  Synthetic oligonucleotide
gtcagccccaagccctgcgttgccctgccctgccctgcgccgccctgccctgcgatgggtctggtccatctgggtgcccttcctcagccccagcccctctctgctcacctcgcg

SEQ ID NO: 4656 - DNA, 115 bp, Artificial Sequence
  Synthetic oligonucleotide
ctggaggatgacatcgtggccaagcccaactacctgagcaccatgaagaactttgcactgcagcagccttcagaggactggatgatcctggagttctcccagctgggcttcattg

SEQ ID NO: 4657 - DNA, 60 bp, Artificial Sequence
  Synthetic oligonucleotide
aagcactgtgaccggcagaaagccaacctgcggatccgcttcaaaccgtccctcttccag

SEQ ID NO: 4658 - DNA, 48 bp, Artificial Sequence
  Synthetic oligonucleotide
cacgtgggcactcactcctcgctggctggcaagatccagaaactgaag

SEQ ID NO: 4659 - DNA, 27 bp, Artificial Sequence
  Synthetic oligonucleotide
gtgggctgcactgcacgctctccctag

SEQ ID NO: 4660 - DNA, 54 bp, Artificial Sequence
  Synthetic oligonucleotide
gccgggatcaaggtcggggcccacgccatcactgctgtccctcctccgctgcag

SEQ ID NO: 4661 - DNA, 57 bp, Artificial Sequence
  Synthetic oligonucleotide
gacaaagactttggaaagcaggcgctgcggaaggagcatgtgaacccgccagcagag

SEQ ID NO: 4662 - DNA, 15 bp, Artificial Sequence
  Synthetic oligonucleotide
gttcttcttccgcag

SEQ ID NO: 4663 - DNA, 64 bp, Artificial Sequence
  Synthetic oligonucleotide
tgggaacatcgagcacccggaggacaagctcttcaacacgtctgtggaggtgctgcccttcgac

SEQ ID NO: 4664 - DNA, 9 bp, Artificial Sequence
  Synthetic oligonucleotide
gtaagttcg

SEQ ID NO: 4665 - DNA, 69 bp, Artificial Sequence
  Synthetic oligonucleotide
gtgggtgtggtgtgcactgaagccgggcctcctgtgaccacctgcctcagcccttgattctgcccccag

SEQ ID NO: 4666 - DNA, 88 bp, Artificial Sequence
  Synthetic oligonucleotide
aaccctcagtcagacaaggaggccctgcaggagggccgcaccgccaccctccggtaccctcggagccccgacggctacctccagatcg

SEQ ID NO: 4667 - DNA, 113 bp, Artificial Sequence
  Synthetic oligonucleotide
gctccttctacaagggagtggcagagggagaggtggacccagccttcggccctctggaagcactgcgcctctcgatccagacggactcccctgtgtgggtgattctgagcgag

SEQ ID NO: 4668 - DNA, 48 bp, Artificial Sequence
  Synthetic oligonucleotide
ctggcccggaggccctaggagctggtgctgcccccgcccgccgggccg

SEQ ID NO: 4669 - DNA, 53 bp, Artificial Sequence
  Synthetic oligonucleotide
cggaggaggcaggcggcccccacactgtgcctgaggcccggaaccgttcgcac

SEQ ID NO: 4670 - DNA, 6946 bp, Homo sapiens
gtctccaatgagcaggcgtgttggggaggagcgcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcagaaataggaaggttgttgattactcacagtttcaggaatctgatgatgcagatgaagattatggaagagattcgggccctcccactaagaaaattcgatcatctccccgagaagctaaaaataagaggcgatctggaaagaattcacaggaagatagtgaggactcagaagacaaagatgtgaagaccaagaaggatgattctcactcagcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagagtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaattctatgtatttttgttttgtgtttggttttcttgtttcacttattcataattggaccaaaaaggccctgtcagttcagttttgtttccctggtctcaaccagtactacttggaagtgatggaactaccaaaagttatttgatagtttcagtttttattcagattaactcttacccttcctgttttcaatctacttttcaaacacatcactcatgtaactctctcatgtaaggtgcatgcaaaatccatttgacaaatgaggccagtgatgactccagtcaaattggtagtacagctccaaatagaatccaagggtgtttgactcccaaatcccatcctctagtcattcttagcactctcttccttttttacttggaaggatgtgtacattaagttagatgttgaaattcttctttcttctcagaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 4671 - DNA, 6000 bp, Homo sapiens
ctcattgttcagctcccacttataagcgagaacatggcagtgtttggtcttttgtgcctgcattagtttgctgaggataatggcctccagctccatccatgtccctgcaaagagcatgatctccttccctttttatggctgcatagtattccatggtgtgtatgtaccacattttctttatccagtctatcattgatgggcatttgagttgattccatcattttgcagaaatgttgaaggatagaatttgcccttttacaatgaaataaagctgcagattatatcctatattggccactgtgttggccttttcagtcagttatgttttcagtcaattattaatcttttgcactatcttgtcaaatataaaattctttaatcattatatcatggtaattctgatattgcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagaaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 4672 - DNA, 6824 bp, Homo sapiens
ctcattgttcagctcccacttataagcgagaacatggcagtgtttggtcttttgtgcctgcattagtttgctgaggataatggcctccagctccatccatgtccctgcaaagagcatgatctccttccctttttatggctgcatagtattccatggtgtgtatgtaccacattttctttatccagtctatcattgatgggcatttgagttgattccatcattttgcagaaatgttgaaggatagaatttgcccttttacaatgaaataaagctgcagattatatcctatattggccactgtgttggccttttcagtcagttatgttttcagtcaattattaatcttttgcactatcttgtcaaatataaaattctttaatcattatatcatggtaattctgatattgcagaggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggagagtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaattctatgtatttttgttttgtgtttggttttcttgtttcacttattcataattggaccaaaaaggccctgtcagttcagttttgtttccctggtctcaaccagtactacttggaagtgatggaactaccaaaagttatttgatagtttcagtttttattcagattaactcttacccttcctgttttcaatctacttttcaaacacatcactcatgtaactctctcatgtaaggtgcatgcaaaatccatttgacaaatgaggccagtgatgactccagtcaaattggtagtacagctccaaatagaatccaagggtgtttgactcccaaatcccatcctctagtcattcttagcactctcttccttttttacttggaaggatgtgtacattaagttagatgttgaaattcttctttcttctcagaagattccggcagcgatgaagatttcctaatggaagatgatgacgatagtgactatggcagttcgaaaaagaaaaacaaaaagatggttaagaagtccaaacctgaaagaaaagaaaagaaaatgcccaaacccagactaaaggctacagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcattcaggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaacatgcattggtagaatcgtgtgatggtcttttgtgatacttaatttttacatatcccagtctctgtatgtatctgcatagacaaagaaaaaacaaactcctgctttgcttttattgaagggtttccaggactgcgtgtctgctcctgagctctgttttaagtatgtgtatcctttgcttgtattttgtattaaaaaaataagaaaaagaagcctttattgttgagcatgttggcattgtcccctttatttttttctctttttgggacatatgaagcaagttattctttttctgtatctttttttcttttgtaaactttttttttgttttgtttaaaaatggctttataaaagggcttttataaccca

SEQ ID NO: 4673 - DNA, 183 bp, Artificial Sequence
  Synthetic oligonucleotide
gtctccaatgagcaggcgtgttggggaggagcgcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagct

SEQ ID NO: 4674 - DNA, 410 bp, Artificial Sequence
  Synthetic oligonucleotide
ctcattgttcagctcccacttataagcgagaacatggcagtgtttggtcttttgtgcctgcattagtttgctgaggataatggcctccagctccatccatgtccctgcaaagagcatgatctccttccctttttatggctgcatagtattccatggtgtgtatgtaccacattttctttatccagtctatcattgatgggcatttgagttgattccatcattttgcagaaatgttgaaggatagaatttgcccttttacaatgaaataaagctgcagattatatcctatattggccactgtgttggccttttcagtcagttatgttttcagtcaattattaatcttttgcactatcttgtcaaatataaaattctttaatcattatatcatggtaattctgatattgcag

SEQ ID NO: 4675 - DNA, 153 bp, Artificial Sequence
  Synthetic oligonucleotide
aggatagtgaagatgaaaaagaagatcataaaaatgtgcgccaacaacggcaggcggcatctaaagcagcttctaaacagagagagatgctcatggaagatgtgggcagtgaggaagaacaagaagaggaggatgaggcaccattccaggaga

SEQ ID NO: 4676 - DNA, 824 bp, Artificial Sequence
  Synthetic oligonucleotide
gtatgtgaagttgttttgtgtactttggttgtttggtcataattgtagtttgtgaccttggttactttggcattttctaggatgctaaatgttacaaccagtcccttaaattgggtagatactccgtgttaaaagagatgactgtattggttcctgttaatatttttaaaggttcagagattctcacgattgcccaccatttgtaatggttgcaccctttatttaatgatgtctgtgttcaaacactgaatgaacaatttgcttaagtaacagtcacattaggcattgtgattgagatttgtattttgccctggtggaggaggttgtagacctcttttcacagaaaaaaacatgttaataataaaatttaggtgtttcacaggttattcagattagttaattctatgtatttttgttttgtgtttggttttcttgtttcacttattcataattggaccaaaaaggccctgtcagttcagttttgtttccctggtctcaaccagtactacttggaagtgatggaactaccaaaagttatttgatagtttcagtttttattcagattaactcttacccttcctgttttcaatctacttttcaaacacatcactcatgtaactctctcatgtaaggtgcatgcaaaatccatttgacaaatgaggccagtgatgactccagtcaaattggtagtacagctccaaatagaatccaagggtgtttgactcccaaatcccatcctctagtcattcttagcactctcttccttttttacttggaaggatgtgtacattaagttagatgttgaaattcttctttcttctcag

SEQ ID NO: 4677 - DNA, 378 bp, Artificial Sequence
  Synthetic oligonucleotide
tgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctcttt

SEQ ID NO: 4678 - DNA, 883 bp, Artificial Sequence
  Synthetic oligonucleotide
ttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatccaaaaaaaaaaaaaccctagaatttaatcaacaagatcagtctacaggtcacagtggatttcttttcaaactgacaatgtttaggttttaagcaaataaagttccagttaatgtgaaactcagtcacaaagagttgagatttttcctttatgaaatagaattgacattcttttatgctataaatgtgcatt

SEQ ID NO: 4679 - DNA, 243 bp, Artificial Sequence
  Synthetic oligonucleotide
caggtcccattaaccatgctctgcttttatttggggatagaacattttctttttcatatcccgatcttcccatttcttcatagaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatg

SEQ ID NO: 4680 - DNA, 312 bp, Artificial Sequence
  Synthetic oligonucleotide
ctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttc

SEQ ID NO: 4681 - DNA, 723 bp, Artificial Sequence
  Synthetic oligonucleotide
ctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttccc

SEQ ID NO: 4682 - DNA, 1416 bp, Artificial Sequence
  Synthetic oligonucleotide
ctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctg

SEQ ID NO: 4683 - DNA, 268 bp, Artificial Sequence
  Synthetic oligonucleotide
aatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttg

SEQ ID NO: 4684 - DNA, 159 bp, Artificial Sequence
  Synthetic oligonucleotide
atggggtgtgggggtatagtactcagcttatgccctaaaataacatgtataaaaacccctgaagtattgtgtgggtgtgtacgtgtgagtgtgtgtttgtatacgtctggcaattaaagctttgtcttctggaacttagtgaattcttttctctttttc

SEQ ID NO: 4685 - DNA, 274 bp, Artificial Sequence
  Synthetic oligonucleotide
acttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttattt

SEQ ID NO: 4686 - DNA, 537 bp, Artificial Sequence
  Synthetic oligonucleotide
cctttattgttgagcatgttggcattgtcccctttatttttttctctttttgggacatatgaagcaagttattctttttctgtatctttttttcttttgtaaactttttttttgttttgtttaaaaatggctttataaaagggcttttataacccagatgtgtgctctgtgtacttcttgtaataccttaaagcaaacacactaacttacacagctttgttaatcagctcccagttcagcctgactttgtgggaacttatttccctaataaattatttagaaactttaacagtgaccatccctgttgttggtaaaagataaacatgtcttggttcaaaagttaatacctcaggatggaatcaagaagcagtagacttaccagtttgattaattaagggagcactggactgggtgcgtaaggattcttaattagcattttttctcatgtttacatccaaggttatgaagtgttgtggaaagcaaagtttaacaatcatatataataaaagataatgtttatactcacagaacacactt

SEQ ID NO: 4687 - DNA, 13 bp, Artificial Sequence
  Synthetic oligonucleotide
cggggttcggcag

SEQ ID NO: 4688 - DNA, 21 bp, Artificial Sequence
  Synthetic oligonucleotide
cagcggtcccatcggctgaag

SEQ ID NO: 4689 - DNA, 103 bp, Artificial Sequence
  Synthetic oligonucleotide
ttcggggggggtggggcgccgagcgcgcggggtggggggggtcctggtctttggcttctcgactcggtcctgtttcgacagcgaacatgtcgcggcctgtcag

SEQ ID NO: 4690 - DNA, 22 bp, Artificial Sequence
  Synthetic oligonucleotide
aaataggaaggttgttgattac

SEQ ID NO: 4691 - DNA, 28 bp, Artificial Sequence
  Synthetic oligonucleotide
tcacagtttcaggaatctgatgatgcag

SEQ ID NO: 4692 - DNA, 106 bp, Artificial Sequence
  Synthetic oligonucleotide
atgaagattatggaagagattcgggccctcccactaagaaaattcgatcatctccccgagaagctaaaaataagaggcgatctggaaagaattcacaggaagatag

SEQ ID NO: 4693 - DNA, 56 bp, Artificial Sequence
  Synthetic oligonucleotide
tgaggactcagaagacaaagatgtgaagaccaagaaggatgattctcactcagcag

SEQ ID NO: 4694 - DNA, 39 bp, Artificial Sequence
  Synthetic oligonucleotide
aagattccggcagcgatgaagatttcctaatggaagatg

SEQ ID NO: 4695 - DNA, 13 bp, Artificial Sequence
  Synthetic oligonucleotide
atgacgatagtga

SEQ ID NO: 4696 - DNA, 98 bp, Artificial Sequence
  Synthetic oligonucleotide
ctatggcagttcgaaaaagaaaaacaaaaagatggttaagaagtccaaacctgaaagaaaagaaaagaaaatgcccaaacccagactaaaggctacag

SEQ ID NO: 4697 - DNA, 51 bp, Artificial Sequence
  Synthetic oligonucleotide
ctccagaagtatttgttacaagatttgtaaataagagctctacttagtttg

SEQ ID NO: 4698 - DNA, 35 bp, Artificial Sequence
  Synthetic oligonucleotide
tttaccatgaacatgttgcagcaaaccttatgcat

SEQ ID NO: 4699 - DNA, 94 bp, Artificial Sequence
  Synthetic oligonucleotide
ctaattcctacaaggttaaagaaaggcttttagacttgccaggttaagcaacagccaagttctcagtaattgtttgccttgatttatcttttag

SEQ ID NO: 4700 - DNA, 68 bp, Artificial Sequence
  Synthetic oligonucleotide
aaaaggtttttttctttaatttaaatgaaatggggttgaagtgaacatgattttgttgaccatgttcg

SEQ ID NO: 4701 - DNA, 80 bp, Artificial Sequence
  Synthetic oligonucleotide
tgaattacagatgcaacatgcattggtagaatcgtgtgatggtcttttgtgatacttaatttttacatatcccagtctct

SEQ ID NO: 4702 - DNA, 18 bp, Artificial Sequence
  Synthetic oligonucleotide
gtatgtatctgcatagac

SEQ ID NO: 4703 - DNA, 25 bp, Artificial Sequence
  Synthetic oligonucleotide
aaagaaaaaacaaactcctgctttg

SEQ ID NO: 4704 - DNA, 31 bp, Artificial Sequence
  Synthetic oligonucleotide
cttttattgaagggtttccaggactgcgtgt

SEQ ID NO: 4705 - DNA, 33 bp, Artificial Sequence
  Synthetic oligonucleotide
ctgctcctgagctctgttttaagtatgtgtatc

SEQ ID NO: 4706 - DNA, 40 bp, Artificial Sequence
  Synthetic oligonucleotide
ctttgcttgtattttgtattaaaaaaataagaaaaagaag

SEQ ID NO: 4707 - DNA, 2799 bp, Homo sapiens
gacgggtggaaaagactcggggttccgagggccgcagaccgctagccctacgtcacttccgcttcctttcccgcagggcgggtaattcgaacgttttttgcagcgagtggccttcccggttggcgcgcgcccggggcggcggcgctggaggagctcgagacggagcctagttatgtctgggaggcgaacgcggtccggaggagccgctcagcgctccggtgagcggagggcgcgcgggagacgtgaggtcgagccgtttgggggacgcagtccggtgaaagatggcctcttccctcccgctgccgccgccggaggaggcgcccttaaaagggcttgtttgggaatcttctcgctgtctctagaacctgttctctggactctaaggtctagagtcctcctctaccacttaacttttttctctttccagggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggatttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccaggccgccggtcctgctttggcttcgaggggctgctgggggcagaagacttgtccggagtctcgccagtggtgtgctccaaactcaccgaggtccccagggtttgtgcaaagccctgggccccagacatgactctccctggaatctccccaccacccgagaaacagaaacgtaagaagaagaaaatgccagagatcttgaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaaggctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggccctaataaaaccctctgccaggtctgggagtcccaggccatctgctcaacgctctgtggtttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttcaaaaac

SEQ ID NO: 4708 - DNA, 813 bp, Homo sapiens
gacgggtggaaaagactcggggttccgagggccgcagaccgctagccctacgtcacttccgcttcctttcccgcagggcgggtaattcgaacgttttttgcagcgagtggccttcccggttggcgcgcgcccggggcggcggcgctggaggagctcgagacggagcctagttatgtctgggaggcgaacgcggtccggaggagccgctcagcgctccggtgagcggagggcgcgcgggagacgtgaggtcgagccgtttgggggacgcagtccggtgaaagatggcctcttccctcccgctgccgccgccggaggaggcgcccttaaaagggcttgtttgggaatcttctcgctgtctctagaacctgttctctggactctaaggtctagagtcctcctctaccacttaacttttttctctttccagggccaagggccccatctcctactaagcctctgcggaggtcccagcggaaatcaggctctgaactcccgagcatcctccctgaaatctggccgaagacacccagtgcggctgcagtcagaaagcccatcgtcttaaagaggatcgtggcccatgctgtagaggtcccagctgtccaatcacctcgcaggagccctaggtctcttaggggcagacaaagagcccactccaagctggccaacaagccagtggtgcagcctgttgaggagcaagaacccaagggccctcaggcttccgaggagcggaacttggagccaccttcctcagaacaactggaacccaccgtcacgttcctgtttacactcctgaacacctctgagcccactgag

SEQ ID NO: 4709 - DNA, 218 bp, Artificial Sequence
  Synthetic oligonucleotide
gacgggtggaaaagactcggggttccgagggccgcagaccgctagccctacgtcacttccgcttcctttcccgcagggcgggtaattcgaacgttttttgcagcgagtggccttcccggttggcgcgcgcccggggcggcggcgctggaggagctcgagacggagcctagttatgtctgggaggcgaacgcggtccggaggagccgctcagcgctccg

SEQ ID NO: 4710 - DNA, 180 bp, Artificial Sequence
  Synthetic oligonucleotide
gtcgagccgtttgggggacgcagtccggtgaaagatggcctcttccctcccgctgccgccgccggaggaggcgcccttaaaagggcttgtttgggaatcttctcgctgtctctagaacctgttctctggactctaaggtctagagtcctcctctaccacttaacttttttctctttccag

SEQ ID NO: 4711 - DNA, 238 bp, Artificial Sequence
  Synthetic oligonucleotide
atttcctttttcttggagaaagaaaacgagccccctggcagggagcttactaaggaggaccttttcaagacacacagcgtccctgccacccccaccagcactcctgtgccgaaccctgaggccgagtccagctccaaggaaggagagctggacgccagagacttggaaatgtctaagaaagtcaggcgttcctacagccggctggagaccctgggctctgcctctacctccaccccag

SEQ ID NO: 4712 - DNA, 135 bp, Artificial Sequence
  Synthetic oligonucleotide
gccgccggtcctgctttggcttcgaggggctgctgggggcagaagacttgtccggagtctcgccagtggtgtgctccaaactcaccgaggtccccagggtttgtgcaaagccctgggccccagacatgactctcc

SEQ ID NO: 4713 - DNA, 141 bp, Artificial Sequence
  Synthetic oligonucleotide
aaaacggagctggatgagtgggctgcggccatgaatgccgagtttgaagctgctgagcagtttgatctcctggttgaatgagatgcagtggggggtgcacctggccagactctccctcctgtcctgtacatagccacctcc

SEQ ID NO: 4714 - DNA, 271 bp, Artificial Sequence
  Synthetic oligonucleotide
cttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctcc

SEQ ID NO: 4715 - DNA, 174 bp, Artificial Sequence
  Synthetic oligonucleotide
ctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagt

SEQ ID NO: 4716 - DNA, 557 bp, Artificial Sequence
  Synthetic oligonucleotide
tttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttctgtggctcatggcctctgggctggtcccttgcacagggcccacgctggagtcttaccactctgctgcaggggtggaaggtggcccctcttgtcacccatacccatttcttacaaaataagttacaccgagtctacttggccctagaagagaaagttgaagagtcccagacctactagcattttgcaactatgcttgtaaagtcctcggaaagtttcctcgcgtaccagacagcggcgggggctgatagcaattttagtttttggcctccctatcctctcacatgagaacactgcctggatgcatctcatgatctctggagaatttccccatctttctcttctttccatcgtgtggattcaatagtgtggatttgaag

SEQ ID NO: 4717 - DNA, 175 bp, Artificial Sequence
  Synthetic oligonucleotide
gctgccctgcccccgactctcctgccgcacccctggccattgtaccttttgatgtttagaagttcgtggaagtagacgctgaggtgtgcagaggagctggtggataacagagaatgccagggaagatgagtgctgggtcagggtacttggatgaaacggtgcaggccaggcgggc

SEQ ID NO: 4718 - DNA, 273 bp, Artificial Sequence
  Synthetic oligonucleotide
tttgtcagacctgcaagcaagccccctgctggggaagcctaggtgtccttgagctgaaccgcactgaagaactcttgtcctcactggctgatgcagcagaactcttgggaaatgtcttagtcctgcagaatcaggagtcaccagatgatgcagagttgagatcatcattgcaaagttctctgttcctgaggaactaaatttaaggaaaaaatgggattttgttttagagttggaaaaaaagcctgattaaagagtttctgcctgttcaaaaac

SEQ ID NO: 4719 - DNA, 29 bp, Artificial Sequence
  Synthetic oligonucleotide
gtgagcggagggcgcgcgggagacgtgag

SEQ ID NO: 4720 - DNA, 7 bp, Artificial Sequence
  Synthetic oligonucleotide
ggccaag

SEQ ID NO: 4721 - DNA, 88 bp, Artificial Sequence
  Synthetic oligonucleotide
ggccccatctcctactaagcctctgcggaggtcccagcggaaatcaggctctgaactcccgagcatcctccctgaaatctggccgaag

SEQ ID NO: 4722 - DNA, 66 bp, Artificial Sequence
  Synthetic oligonucleotide
acacccagtgcggctgcagtcagaaagcccatcgtcttaaagaggatcgtggcccatgctgtagag

SEQ ID NO: 4723 - DNA, 36 bp, Artificial Sequence
  Synthetic oligonucleotide
gtcccagctgtccaatcacctcgcaggagccctagg

SEQ ID NO: 4724 - DNA, 11 bp, Artificial Sequence
  Synthetic oligonucleotide
ctggaatctcc

SEQ ID NO: 4725 - DNA, 51 bp, Artificial Sequence
  Synthetic oligonucleotide
ccaccacccgagaaacagaaacgtaagaagaagaaaatgccagagatcttg

SEQ ID NO: 4726 - DNA, 29 bp, Artificial Sequence
  Synthetic oligonucleotide
ctgtggagaggacacttagggtcccctcc

SEQ ID NO: 4727 - DNA, 61 bp, Artificial Sequence
  Synthetic oligonucleotide
cctggtcttgttacctgtgtgtgtgctggtgctgcgcatgaggactgtctgcctttgaggg

SEQ ID NO: 4728 - DNA, 59 bp, Artificial Sequence
  Synthetic oligonucleotide
cctaataaaaccctctgccaggtctgggagtcccaggccatctgctcaacgctctgtgg

SEQ ID NO: 4729 - DNA, 114 bp, Artificial Sequence
  Synthetic oligonucleotide
tctcttaggggcagacaaagagcccactccaagctggccaacaagccagtggtgcagcctgttgaggagcaagaacccaagggccctcaggcttccgaggagcggaacttggag

SEQ ID NO: 4730 - DNA, 75 bp, Artificial Sequence
  Synthetic oligonucleotide
ccaccttcctcagaacaactggaacccaccgtcacgttcctgtttacactcctgaacacctctgagcccactgag

SEQ ID NO: 4731 - DNA, 2800 bp, Homo sapiens
ggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 4732 - DNA, 3169 bp, Homo sapiens
gtccgcggcgggctccgggcccccgcgatgtctcccggtccccgcgtgcctgcacaccgccttcctgagaggcgccgtgtgttcagcgaaagaacaaagagacggcggcggcgcttccacacggccagtggcgtcccttacagcgaaccccgccgccgcccgcgcgcgcacgcgctgccagtgcccgcccgcccacgagccctgagcgcactctgcgtggggctggctcggcgcctccgagcccggcgggccctgtgattggacgggcgcccgcctcgcgtcccgccaatcggggcggcgcttgattgggctgggggggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 4733 - DNA, 3142 bp, Homo sapiens
gtccgcggcgggctccgggcccccgcgatgtctcccggtccccgcgtgcctgcacaccgccttcctgagaggcgccgtgtgttcagcgaaagaacaaagagacggcggcggcgcttccacacggccagtggcgtcccttacagcgaaccccgccgccgcccgcgcgcgcacgcgctgccagtgcccgcccgcccacgagccctgagcgcactctgcgtggggctggctcggcgcctccgagcccggcgggccctgtgattggacgggcgcccgcctcgcgtcccgccaatcggggcggcgcttgattgggctgggggggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 4734 - DNA, 2656 bp, Homo sapiens
ttagtttaactcataaacagaaaaacagttgtattagggttccttaacaaacgtaatccagcaccagattagtattggtgttaggctgtctggagcctaattgctcacacgcttccaacagaatctgagccttgaatttttcttctttaaaaacacaactttgtccttttttttttttttccttccttttctcagtctttaaatatggctttttacaaatatttaaaagatgatttgttttgtggaaatgtcacttgtttttctccaaattaattttcatcttgtataattctgaatagtccatttccagcatttcccttttgtatatgaggaagtaagtttttgcaagaaattctgtgaagttagcactgctgtcaatgttcacactcttttcatgtagcagtgtacccgcatttgaatctttctgttacattattttggaattttaggtttcaaacagtgtatctttctaaaatccgtttttttgacattgtaattttctgtggcaagacactataagctctcaccaggttcttggattgggtatgattcacaggaattgaatgttagtaatctggggctgtcctctttatcattaaaaatgagtttttacaactggtgacaagctgattgctgacctttctttagaaatcaagaaattgtatgtcagaattaaaaataggaaatctgatttaattgtagagggtctatcaactgcttagacagagatagtaagattcaatttaagtaaatgtttataaccatagttatgcgcatcagttttacttgcaaggagaaaaatgagaaatcacgactcattccagaatttactgtttttccttcctgcttaatggttggaggaggaggaatggagaatacgttgtgatcattcagtaagagcctgaaggaaagttgtatgaagtaacgtaaaccacatattagcaagattataatccattaattgacttttccagtggaactggaagagtgaaaaagtaagtattttatagttatattagattctttgtttcatttattttgcagcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 4735 - DNA, 762 bp, Homo sapiens
gctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 4736 - DNA, 916 bp, Homo sapiens
gctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaaggtaggtacctttgacgtgagaattggaactcccttttcagtcctgtgatgatggacttgaatacttctgggatagttgtttgttatgtgaacaagtcagttaaccccccgtggcccgtcttcatgctcactgacaccagtgtgtctctttgcagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtc

SEQ ID NO: 4737 - DNA, 982 bp, Homo sapiens
gctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttagattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtcaaaaatgaaacatctctcataacgtgtcaataactgctttcaggactgctcaacaaaaaacttttaaatttaactccttgggttttttagttgtctttgtatgaatcttgatttaactaatactgcctgtgaatatgtggaagacatatatgaagaacactgctgtgcatcctgagggcttacccagtaaagggcttgatcttatagacaagaccagggt

SEQ ID NO: 4738 - DNA, 895 bp, Homo sapiens
gtccgcggcgggctccgggcccccgcgatgtctcccggtccccgcgtgcctgcacaccgccttcctgagaggcgccgtgtgttcagcgaaagaacaaagagacggcggcggcgcttccacacggccagtggcgtcccttacagcgaaccccgccgccgcccgcgcgcgcacgcgctgccagtgcccgcccgcccacgagccctgagcgcactctgcgtggggctggctcggcgcctccgagcccggcgggccctgtgattggacgggcgcccgcctcgcgtcccgccaatcggggcggcgcttgattgggctgggggggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggttggttaacataacatgttgtagtaattatcatcatcttttggtttatgctattggaacatttgtttggttattgggaggaaatcattgacctcagggtgtccatctttttattgctatttctttttaatgtgcaactgttaatgactgctgtagatcacac

SEQ ID NO: 4739 - DNA, 470 bp, Homo sapiens
gtctgaggatttacagtgatagcttttgttttcattctgtagtctactttgtccccagtccattttcaccctccttttttgatgatgcgattgtgttttattctctagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatggtatgtttcagagctgggaggcagtgagttcctgagttgcatgtggcagccttctgccggccgagtgttcagaaacgagggtagaggtcagtgaggtgaccagaaggaggatctccttagaggcatggggggctgcttgcttgaaaggaactggagcaaggaattcctcagggagcagatagac

SEQ ID NO: 4740 - DNA, 416 bp, Artificial Sequence
  Synthetic oligonucleotide
gtccgcggcgggctccgggcccccgcgatgtctcccggtccccgcgtgcctgcacaccgccttcctgagaggcgccgtgtgttcagcgaaagaacaaagagacggcggcggcgcttccacacggccagtggcgtcccttacagcgaaccccgccgccgcccgcgcgcgcacgcgctgccagtgcccgcccgcccacgagccctgagcgcactctgcgtggggctggctcggcgcctccgagcccggcgggccctgtgattggacgggcgcccgcctcgcgtcccgccaatcggggcggcgcttgattgggctgggggggccaaataaaagcgatggcgattgggctgccgcgtttggcgctcggtccggtcgcgtccgacacccggtgggactcagaaggcagtggagccccggcg

SEQ ID NO: 4741 - DNA, 289 bp, Artificial Sequence
  Synthetic oligonucleotide
ggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgccta

SEQ ID NO: 4742 - DNA, 124 bp, Artificial Sequence
  Synthetic oligonucleotide
aataatcatgggccagactgggaagaaatctgagaagggaccagtttgttggcggaagcgtgtaaaatcagagtacatgcgactgagacagctcaagaggttcagacgagctgatgaagtaaag

SEQ ID NO: 4743 - DNA, 163 bp, Artificial Sequence
  Synthetic oligonucleotide
gttggttaacataacatgttgtagtaattatcatcatcttttggtttatgctattggaacatttgtttggttattgggaggaaatcattgacctcagggtgtccatctttttattgctatttctttttaatgtgcaactgttaatgactgctgtagatcacac

SEQ ID NO: 4744 - DNA, 179 bp, Artificial Sequence
  Synthetic oligonucleotide
gccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgat

SEQ ID NO: 4745 - DNA, 121 bp, Artificial Sequence
  Synthetic oligonucleotide
gtggaagatgaaactgttttacataacattccttatatgggagatgaagttttagatcaggatggtactttcattgaagaactaataaaaaattatgatgggaaagtacacggggatagag

SEQ ID NO: 4746 - DNA, 141 bp, Artificial Sequence
  Synthetic oligonucleotide
aatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatg

SEQ ID NO: 4747 - DNA, 164 bp, Artificial Sequence
  Synthetic oligonucleotide
atataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatc

SEQ ID NO: 4748 - DNA, 1044 bp, Artificial Sequence
  Synthetic oligonucleotide
ttagtttaactcataaacagaaaaacagttgtattagggttccttaacaaacgtaatccagcaccagattagtattggtgttaggctgtctggagcctaattgctcacacgcttccaacagaatctgagccttgaatttttcttctttaaaaacacaactttgtccttttttttttttttccttccttttctcagtctttaaatatggctttttacaaatatttaaaagatgatttgttttgtggaaatgtcacttgtttttctccaaattaattttcatcttgtataattctgaatagtccatttccagcatttcccttttgtatatgaggaagtaagtttttgcaagaaattctgtgaagttagcactgctgtcaatgttcacactcttttcatgtagcagtgtacccgcatttgaatctttctgttacattattttggaattttaggtttcaaacagtgtatctttctaaaatccgtttttttgacattgtaattttctgtggcaagacactataagctctcaccaggttcttggattgggtatgattcacaggaattgaatgttagtaatctggggctgtcctctttatcattaaaaatgagtttttacaactggtgacaagctgattgctgacctttctttagaaatcaagaaattgtatgtcagaattaaaaataggaaatctgatttaattgtagagggtctatcaactgcttagacagagatagtaagattcaatttaagtaaatgtttataaccatagttatgcgcatcagttttacttgcaaggagaaaaatgagaaatcacgactcattccagaatttactgtttttccttcctgcttaatggttggaggaggaggaatggagaatacgttgtgatcattcagtaagagcctgaaggaaagttgtatgaagtaacgtaaaccacatattagcaagattataatccattaattgacttttccagtggaactggaagagtgaaaaagtaagtattttatagttatattagattctttgtttcatttattttgcag

SEQ ID NO: 4749 - DNA, 241 bp, Artificial Sequence
  Synthetic oligonucleotide
gagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctg

SEQ ID NO: 4750 - DNA, 126 bp, Artificial Sequence
  Synthetic oligonucleotide
acggctcctctaaccatgtttacaactatcaaccctgtgatcatccacggcagccttgtgacagttcgtgcccttgtgtgatagcacaaaatttttgtgaaaagttttgtcaatgtagttcagagt

SEQ ID NO: 4751 - DNA, 179 bp, Artificial Sequence
  Synthetic oligonucleotide
gtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaag

SEQ ID NO: 4752 - DNA, 184 bp, Artificial Sequence
  Synthetic oligonucleotide
gtatgtttcagagctgggaggcagtgagttcctgagttgcatgtggcagccttctgccggccgagtgttcagaaacgagggtagaggtcagtgaggtgaccagaaggaggatctccttagaggcatggggggctgcttgcttgaaaggaactggagcaaggaattcctcagggagcagatagac

SEQ ID NO: 4753 - DNA, 272 bp, Artificial Sequence
  Synthetic oligonucleotide
gctatgttttgctcagtaatgtatgtttatagttgataattaatagcttttgagtcagataaccatcttgaattataggtgattaattttaacctggaacaatagtgtgttcttccaaatgtcatttcttactgaatgaagctgcttgatttatttgcttttgcaggcaaaccctgaagaactgtaaccagttgcatttacaaaatcataataacttggtttacttataactgaaattattcactgggctgtgcttacttttttctttttag

SEQ ID NO: 4754 - DNA, 154 bp, Artificial Sequence
  Synthetic oligonucleotide
gtaggtacctttgacgtgagaattggaactcccttttcagtcctgtgatgatggacttgaatacttctgggatagttgtttgttatgtgaacaagtcagttaaccccccgtggcccgtcttcatgctcactgacaccagtgtgtctctttgcag

SEQ ID NO: 4755 - DNA, 133 bp, Artificial Sequence
  Synthetic oligonucleotide
atacagccaggctgatgccctgaagtatgtcggcatcgaaagagaaatggaaatcccttgacatctgctacctcctcccccctcctctgaaacagctgccttagcttcaggaacctcgagtactgtgggcaat

SEQ ID NO: 4756 - DNA, 382 bp, Artificial Sequence
  Synthetic oligonucleotide
tgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtcaaaaatgaaacatctctcataacgtgtcaataactgctttcaggactgctcaacaaaaaacttttaaatttaactccttgggttttttagttgtctttgtatgaatcttgatttaactaatactgcctgtgaatatgtggaagacatatatgaagaacactgctgtgcatcctgagggcttacccagtaaagggcttgatcttatagacaagaccagggt

SEQ ID NO: 4757 - DNA, 27 bp, Artificial Sequence
  Synthetic oligonucleotide
gcggcggcggcggcgcgcgggggcgac

SEQ ID NO: 4758 - DNA, 36 bp, Artificial Sequence
  Synthetic oligonucleotide
gcgcgggaacaacgcgagtcggcgcgcgggacgaag

SEQ ID NO: 4759 - DNA, 102 bp, Artificial Sequence
  Synthetic oligonucleotide
agtatgtttagttccaatcgtcagaaaattttggaaagaacggaaatcttaaaccaagaatggaaacagcgaaggatacagcctgtgcacatcctgacttct

SEQ ID NO: 4760 - DNA, 27 bp, Artificial Sequence
  Synthetic oligonucleotide
gtgagctcattgcgcgggactagggag

SEQ ID NO: 4761 - DNA, 117 bp, Artificial Sequence
  Synthetic oligonucleotide
tgttcggtgaccagtgacttggattttccaacacaagtcatcccattaaagactctgaatgcagttgcttcagtacccataatgtattcttggtctcccctacagcagaattttatg

SEQ ID NO: 4762 - DNA, 103 bp, Artificial Sequence
  Synthetic oligonucleotide
ataaagaaagccgcccacctcggaaatttccttctgataaaatttttgaagccatttcctcaatgtttccagataagggcacagcagaagaactaaaggaaaa

SEQ ID NO: 4763 - DNA, 92 bp, Artificial Sequence
  Synthetic oligonucleotide
cttttcatgcaacacccaacacttataagcggaagaacacagaaacagctctagacaacaaaccttgtggaccacagtgttaccagcatttg

SEQ ID NO: 4764 - DNA, 59 bp, Artificial Sequence
  Synthetic oligonucleotide
aagcaaattctcggtgtcaaacaccaataaagatgaagccaaatattgaacctcctgag

SEQ ID NO: 4765 - DNA, 111 bp, Artificial Sequence
  Synthetic oligonucleotide
aatgtggagtggagtggtgctgaagcctcaatgtttagagtcctcattggcacttactatgacaatttctgtgccattgctaggttaattgggaccaaaacatgtagacag

SEQ ID NO: 4766 - DNA, 95 bp, Artificial Sequence
  Synthetic oligonucleotide
gtgtatgagtttagagtcaaagaatctagcatcatagctccagctcccgctgaggatgtggatactcctccaaggaaaaagaagaggaaacaccg

SEQ ID NO: 4767 - DNA, 41 bp, Artificial Sequence
  Synthetic oligonucleotide
gttgtgggctgcacactgcagaaagatacagctgaaaaagg

SEQ ID NO: 4768 - DNA, 108 bp, Artificial Sequence
  Synthetic oligonucleotide
gtctgaggatttacagtgatagcttttgttttcattctgtagtctactttgtccccagtccattttcaccctccttttttgatgatgcgattgtgttttattctctag

SEQ ID NO: 4769 - DNA, 96 bp, Artificial Sequence
  Synthetic oligonucleotide
catctattgctggcaccatctgacgtggcaggctgggggatttttatcaaagatcctgtgcagaaaaatgaattcatctcagaatactgtggagag

SEQ ID NO: 4770 - DNA, 82 bp, Artificial Sequence
  Synthetic oligonucleotide
attatttctcaagatgaagctgacagaagagggaaagtgtatgataaatacatgtgcagctttctgttcaacttgaacaatg

SEQ ID NO: 4771 - DNA, 81 bp, Artificial Sequence
  Synthetic oligonucleotide
attttgtggtggatgcaacccgcaagggtaacaaaattcgttttgcaaatcattcggtaaatccaaactgctatgcaaaag

SEQ ID NO: 4772 - DNA, 85 bp, Artificial Sequence
  Synthetic oligonucleotide
ttatgatggttaacggtgatcacaggataggtatttttgccaagagagccatccagactggcgaagagctgttttttgattacag

SEQ ID NO: 4773 - DNA, 29 bp, Artificial Sequence
  Synthetic oligonucleotide
ttagaaaaagaacatgcagtttgaaattc

SEQ ID NO: 4774 - DNA, 276 bp, Artificial Sequence
  Synthetic oligonucleotide
aggggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaag

SEQ ID NO: 4775 - DNA, 266 bp, Artificial Sequence
  Synthetic oligonucleotide
ggggaagacttgttgatttttccatatcccccggcctgacaaagaaattggggagcgcttgagtgctggggtacctgggaagtgacgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtcccag

SEQ ID NO: 4776 - DNA, 301 bp, Artificial Sequence
  Synthetic oligonucleotide
tgaggctcagggtggcttttcccagggtcccatggtgaggaagtgggggactgggttggaacctgggtcgagggatctcggggctggaggagggggctggtggggggcgggtcctcgggcgagagacagatcccagcgccgccctcctcccccccagcgccggccccagagccgcgcagagccgcgcagagacgccgcgccttataaggcggcctcggggagcccgggccacgctatataagggccggtttgctttataaagccgggctggtggcgtggggggcggcagggccagggccag

SEQ ID NO: 4777 - DNA, 665 bp, Artificial Sequence
  Synthetic oligonucleotide
gtgagggggccgcccctcccacctccccccactcacccgggagaagaagaggcagcccggtcccctaggggctgggagcctggctgggcttgggcggagggttctggagaaatgggagtggagtgggggaggggggggacagtggagagagggaaaagcagggaggtggggggagaggcagacagagatactgggagcctgagacaccctagggacagacgggggagggcgagccaggagcgagataagacctagacaaggatggaggggcagggagaggagacagagccccaccacccccaccccaggcaggaaacctggagacagagaaagacctagagaggcagatatacaagacccaggagccctacccctggccagacagggactagccacctagagagatggggacccaagactgggccaagaaaagacagcgctggggaagagagagacagaggagtcggggggataagagggagagagacatacagacgtgcaaggggtgggggctaagacagagacaagcccccaccactaaccagagacagagccctggagctgaagacctgggggacacggagagacagagatgtatgaccagcactcctctgcaagccagcacccagggacacctccttagacatccttcttcccttcctgag

SEQ ID NO: 4778 - DNA, 238 bp, Artificial Sequence
  Synthetic oligonucleotide
caaaattagccgggcatggtggcaggcgcttgtagtcccagctactagggagactgatgcaggagaatggtgtgaagccgggaggcggagcttgcagtgagctgagatcacgccactgcactccagcctgggcaacagagcgagactctgtgtcaacaacaacaaaaaaacagtgtccaaggggactgtgcagcctggaggcccccttgtcagtccctgctttccctgccccacctag

SEQ ID NO: 4779 - DNA, 128 bp, Artificial Sequence
  Synthetic oligonucleotide
atgggcaccaacaagtttgccagccagcagggcatgacggcctatggcacccggcgccacctctacgaccccaagctgggcacagaccagcctctggaccaggcgaccatcagcctgcagatgggcac

SEQ ID NO: 4780 - DNA, 170 bp, Artificial Sequence
  Synthetic oligonucleotide
gcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacag

SEQ ID NO: 4781 - DNA, 44 bp, Artificial Sequence
  Synthetic oligonucleotide
ctggcccagaagtatgaccaccagcgggagcaggagctgagaga

SEQ ID NO: 4782 - DNA, 28 bp, Artificial Sequence
  Synthetic oligonucleotide
gtggatcgagggggtgacaggccgtcgc

SEQ ID NO: 4783 - DNA, 50 bp, Artificial Sequence
  Synthetic oligonucleotide
atcggcaacaacttcatggacggcctcaaagatggcatcattctttgcga

SEQ ID NO: 4784 - DNA, 67 bp, Artificial Sequence
  Synthetic oligonucleotide
attcatcaataagctgcagccaggctccgtgaagaagatcaatgagtcaacccaaaattggcaccag

SEQ ID NO: 4785 - DNA, 105 bp, Artificial Sequence
  Synthetic oligonucleotide
ctggagaacatcggcaacttcatcaaggccatcaccaagtatggggtgaagccccacgacatttttgaggccaacgacctgtttgagaacaccaaccatacacag

SEQ ID NO: 4786 - DNA, 33 bp, Artificial Sequence
  Synthetic oligonucleotide
gtgcagtccaccctcctggctttggccagcatg

SEQ ID NO: 4787 - DNA, 88 bp, Artificial Sequence
  Synthetic oligonucleotide
gcgaagacgaaaggaaacaaggtgaacgtgggagtgaagtacgcagagaagcaggagcggaaattcgagccggggaagctaagagaag

SEQ ID NO: 4788 - DNA, 23 bp, Artificial Sequence
  Synthetic oligonucleotide
ggcggaacatcattgggctgcag

SEQ ID NO: 4789 - DNA, 19 bp, Artificial Sequence
  Synthetic oligonucleotide
caacaaaggagccagccag

SEQ ID NO: 4790 - DNA, 56 bp, Artificial Sequence
  Synthetic oligonucleotide
gctggcatgactgcgccagggaccaagcggcagatcttcgagccggggctgggcat

SEQ ID NO: 4791 - DNA, 34 bp, Artificial Sequence
  Synthetic oligonucleotide
ggagcactgcgacacgctcaatgtcagcctgcag

SEQ ID NO: 4792 - DNA, 8 bp, Artificial Sequence
  Synthetic oligonucleotide
atgggcag

SEQ ID NO: 4793 - DNA, 98 bp, Artificial Sequence
  Synthetic oligonucleotide
caacaagggcgcctcgcagcggggcatgacggtgtatgggctgccacgccaggtctacgaccccaagtactgtctgactcccgagtacccagagctgg

SEQ ID NO: 4794 - DNA, 74 bp, Artificial Sequence
  Synthetic oligonucleotide
gtgagcccgcccacaaccaccacgcacacaactactacaattccgcctagggccacaaggccttccctgttttc

SEQ ID NO: 4795 - DNA, 12 bp, Artificial Sequence
  Synthetic oligonucleotide
cccccaagggag

SEQ ID NO: 4796 - DNA, 31 bp, Artificial Sequence
  Synthetic oligonucleotide
gctgctgctgctcttggctggacccagccag

SEQ ID NO: 4797 - DNA, 34 bp, Artificial Sequence
  Synthetic oligonucleotide
cgcccaaaggacgcactgagcaacgctattccag

SEQ ID NO: 4798 - DNA, 59 bp, Artificial Sequence
  Synthetic oligonucleotide
ctgtccccccactccctcacaagtgggtacccccaggaccagaagctcccccagcaaag

SEQ ID NO: 4799 - DNA, 99 bp, Artificial Sequence
  Synthetic oligonucleotide
cccccagagcccaggctcggcctgcccccaccccattcccgcagtgggagcaaactgcatgcccagagacccagcggacacacgcggtttggtttgcag

SEQ ID NO: 4800 - DNA, 26 bp, Artificial Sequence
  Synthetic oligonucleotide
cgactggcatactatgtggatgtgac

SEQ ID NO: 4801 - DNA, 80 bp, Artificial Sequence
  Synthetic oligonucleotide
agtggcgtttgtaatgagagcactttcttttttttctatttcactggagcacaataaatggctgtaaaatctcctgaggc

SEQ ID NO: 4802 - DNA, 205 bp, Artificial Sequence
  Synthetic oligonucleotide
ctagagcgagactccatcacaaaaaaaaaaaaaaaaaaagagaaaggagacgaaaaacaagaagagctcagctttaaaaaaggatcacgacgtagaaaaagacacaacactgaagattgtcatgggtctttaagaaaaggaaatttgagacggctaaaacgccgaacagtgtggagtttggggaagagatgtggctaaagacagc

SEQ ID NO: 4803 - DNA, 223 bp, Artificial Sequence
  Synthetic oligonucleotide
gtacgtttcccctccccggtcaaggatcttttattatacgctatcatagaatcatattcctttccttagcgcacttctctcaactgataagtgccgccattaatgtacttacttgataaatatatgcctgcctttcctcttccagggccgaaactgtgcctggttttgctcatcattctatagtctatagcacgagttcaataaacagttgttaaagcaacat

SEQ ID NO: 4804 - DNA, 514 bp, Artificial Sequence
  Synthetic oligonucleotide
cccgccttgggatgtttcttatatcccaagaaacagaatattttgatgggatcgctgatgtttcagactgcaaaagcagctcagggcgtttgcagtcgtgcaagtcaacaagataaccgtctggaccggaagctgggctcctcccggtctcctaacgccaaatccaacaccaagcttctgcagctgccacctcccgtagacttcgcatttcttccgcactctcctctcacgacgggtcttctttgttgtacttaatttcctacgcaataagatttcagcatcaccatcagtcccccaaagactaattcccacagagccgaagttcccaccaagggccgagggttaaggttactaaaatcagcgtttctgaatcctgtctcaagttgtctcatctgggcttccgtaagaacggtttcttcataagagggccttcagcgacagccgagctcggaaaagaacgggaataagttgtcttttatatttcctcaaatactgtgaatggtctgaggcgcag

SEQ ID NO: 4805 - DNA, 354 bp, Artificial Sequence
  Synthetic oligonucleotide
gtcaggtgtatttaaaaacctttaaacagtattcccccgccccaaaaactggccttgaaggaacaagtgaaactcatcctgcttttcatgtttgctgggtttgcccgttacaccccttcgcccgcacttatctagacaggcagctctcggccaccctccggggtcctgattttgaaaagaggagtggaccaatcagatgtggagcgctgtttcgcgctgccatttgagcctgggctgaaactgcgggtgtgacccccccgtggtggctctgggtgtctgcggaggagctgggggcggaagcatgaggctaacggcttggcttcagtgaacgcaccgggatgtgcaggccgggag

SEQ ID NO: 4806 - DNA, 197 bp, Artificial Sequence
  Synthetic oligonucleotide
gtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcag

SEQ ID NO: 4807 - DNA, 195 bp, Artificial Sequence
  Synthetic oligonucleotide
agcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaaggg

SEQ ID NO: 4808 - DNA, 341 bp, Artificial Sequence
  Synthetic oligonucleotide
ctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaataggg

SEQ ID NO: 4809 - DNA, 254 bp, Artificial Sequence
  Synthetic oligonucleotide
aataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttag

SEQ ID NO: 4810 - DNA, 164 bp, Artificial Sequence
  Synthetic oligonucleotide
atccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattg

SEQ ID NO: 4811 - DNA, 124 bp, Artificial Sequence
  Synthetic oligonucleotide
ggcgtgtaccagattttatcctggaaaagataccagccatgttgggtattgatggtctctgtgctactccatcactggaaggctttgaagaaggtgaatatgaaactcctggtgaatataagag

SEQ ID NO: 4812 - DNA, 139 bp, Artificial Sequence
  Synthetic oligonucleotide
aatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaag

SEQ ID NO: 4813 - DNA, 341 bp, Artificial Sequence
  Synthetic oligonucleotide
gtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgacttatttgccatgtgcttgggtattatttcaaaacaaggttaaatacaaaggattaagcactgaactgctttattttag

SEQ ID NO: 4814 - DNA, 2411 bp, Artificial Sequence
  Synthetic oligonucleotide
gttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttata

SEQ ID NO: 4815 - DNA, 1051 bp, Artificial Sequence
  Synthetic oligonucleotide
atgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatggcttcttctcactgtcttataaatgtaaataaagatctaatattaatttggttatct

SEQ ID NO: 4816 - DNA, 94 bp, Artificial Sequence
  Synthetic oligonucleotide
gcatttgcttcctgaatgatggtcccactcagccatccacctatactttctacaaagtcaatttatactgattcttcagatcagttaatcactg

SEQ ID NO: 4817 - DNA, 71 bp, Artificial Sequence
  Synthetic oligonucleotide
ggtaaaatatttggagtaccttttaatgcactgccccattctgctgtaccagaatatggacacattccaag

SEQ ID NO: 4818 - DNA, 97 bp, Artificial Sequence
  Synthetic oligonucleotide
ctttcttgtcgatgcttgcacatctttagaagaccatattcataccgaagggctttttcggaaatcaggatctgtgattcgcctaaaagcactaaag

SEQ ID NO: 4819 - DNA, 23 bp, Artificial Sequence
  Synthetic oligonucleotide
aaagagaagacaaagtgtaggag

SEQ ID NO: 4820 - DNA, 75 bp, Artificial Sequence
  Synthetic oligonucleotide
attttgttagtggagcactaaataaatttaaacctaacagaacaccttctattacacctcaagaagaaagaattg

SEQ ID NO: 4821 - DNA, 81 bp, Artificial Sequence
  Synthetic oligonucleotide
cccagctatctgaatcaccagtgattcttacaccaaatgctaagcgtacattgccagtagattcttctcatggtttctcaa

SEQ ID NO: 4822 - DNA, 87 bp, Artificial Sequence
  Synthetic oligonucleotide
gtaagaaaaggaagtccatcaagcacaattttaactttgagctgttgccaagtaatctcttcaatagcagttctacaccggtatcag

SEQ ID NO: 4823 - DNA, 84 bp, Artificial Sequence
  Synthetic oligonucleotide
ttcacatcgatacaagctcagaagggtcatctcagagttcactctctcctgtactcattggtggaaaccatttgatcactgcag

SEQ ID NO: 4824 - DNA, 46 bp, Artificial Sequence
  Synthetic oligonucleotide
gtgtgccaaggcgaagtaaaagaattgcaggcaaaaaagtttgcag

SEQ ID NO: 4825 - DNA, 109 bp, Artificial Sequence
  Synthetic oligonucleotide
agtggaatcaggaaaagcaggctgcttttctcctaaaatcagccataaagaaaaggttcgaagatctctgcgtttgaaattcaatctagggaaaaatggcagagaagta

SEQ ID NO: 4826 - DNA, 115 bp, Artificial Sequence
  Synthetic oligonucleotide
gtgccagtaggtgtaccttgtgttcactcgaactaagaacaatggttaaggcagaataatgactaaaatatgttcatatattatgatgtggaaataattgataacttttaagcca

SEQ ID NO: 4827 - DNA, 119 bp, Artificial Sequence
  Synthetic oligonucleotide
tactatgtttttaaagataatttgcacaaacacgtttgtgtctgttctgtccaatatagatttggcaattatttaaagagggataatcttgaaaaaaattaaccaaggtgatttcttat

SEQ ID NO: 4828 - DNA, 214 bp, Artificial Sequence
  Synthetic oligonucleotide
taaaaatagcttgcgggcaggggagctaccagcagttcagtgcttctggagtttaaagagcccggcgagggtcatgtcagatgacgccggtccacgagaaggagggtggattatatccttagagacgccatagagtgaggatataatggctctgtaacaagcataaactgtgatggtctgggatgccctcgtcatagacagcccctggagagtc

SEQ ID NO: 4829 - DNA, 152 bp, Artificial Sequence
  Synthetic oligonucleotide
ggcttacaattaagtccatacccccgcctcccgcctggctttcacttccttgcttttggagagaagatgaatggaaatgtatgactttgtctgtggtataaagacatggattcaagttcagggtttgccatggacctgccgtgtgacctttg

SEQ ID NO: 4830 - DNA, 957 bp, Artificial Sequence
  Synthetic oligonucleotide
ctttgttaagttgtttatttggtacagacaagctgccaagactgcaaatgagacggcgcttggttgttgttcattcctgctgatggcttggcgaggccaatcttccttctgtgttgcgaatccacatggcttaacccctccggtccttccctcatcactctgcagcctttgccatgagcatttctcggagctgttgtgagaacccagtgggtcagaggtgacagctttattaaagattaagctgtcctctcttcccttggggctggtaatatttaactcttgctttgcaaattgttttttcatagatttacacactctccaacaggatcatcattgcttgagggcaggtatcacactgtacactttccacaaggccttcactgtcttacacaagcattcaataaatatttgtgggtttagggtgcatgcgtgtgtatgcacacatgtgtacacatgtgcaatgttactggagatggaagagttacacagaaaaccccagggaatcagtcagcaggcaattttaagcccagctgcttggggggtggtgggggtggttgataacaggacaaagtccgcaattatcatttaggggactttttgtaatggaatcctttagagaatcagctcagatgacatattattctaaccccaaactcaagattttctctctggctgcctgtagaaaaagaggtgtgcatttgcatgggaggatagctgttcctgcaaacatttattcaaggacaggaaaaggcagggcccctgagaacaagaaaaaatcagtgggtggttgaaccacgcagtgggaggagtggggtttctgaagccgtcagggcagcatacaaaaccaggctctgctgcttgcagtgaatctctcctccattgtaactgagatacgtatatcctcttttttctttctgctgtttctgtgttaacggcaaatccacttcttaatttcag

SEQ ID NO: 4831 - DNA, 775 bp, Artificial Sequence
  Synthetic oligonucleotide
gaaggtccacagaaaacatcctggggtcctgagctgaagtgtgatgggaggagtcctctgtatctcagtctgatcctggtctccctctcggccatggtctcacactagtgctgctgggaaaccatccctcacatccagtcctggcatcgggcagtgactctggtccaactgttgtccaactcaagggtttagctgcttagattttcctaaaacttgaatttcattttcctctagccatggaatacagattaatcctttacaattaaaatccaagttcagattttatttgttgtggtttttaattaaaatctcaccagcactttgtggattttttttttcttagaaaggcaaacacactgtgcgtatcagtcagcctggactgccatcacaaaataccatagactgtgtgtcttaaaacaacagaaatgtattttctcacagttctggaggctggaagttcaaggtcaatgttctggatgatttggtttccagtgaggcctctctttcttgcttgcagatggctgccattcttctgtgtcctgtagggaagttcaaacttttcctctgaaggtttgaacaaactgacaatatgcagactaataggaggaagaaaggcattcaaagttgctaatgtgcataagcacaaggccacagaaaatatgagattcaaaggagcaccaggcgcctgaggcttaaataccctcctcataagggagagggaaatggggttgtaggcaattgcgaggggcagtaaatgactttcagtaaacgcatg

SEQ ID NO: 4832 - DNA, 1138 bp, Artificial Sequence; identical to SEQ ID NO: 4048
  Synthetic oligonucleotide

SEQ ID NO: 4833 - DNA, 146 bp, Artificial Sequence
  Synthetic oligonucleotide
gagggacaaagggctgaaagaacaagcataccaggcatgtacctctgcaagcctaactttgaaaattcctttattcttccagtggccagaactgggtcatatggtctcccctaagtgcagattatcccaacctgcactctggaaag

SEQ ID NO: 4834 - DNA, 148 bp, Artificial Sequence
  Synthetic oligonucleotide
gatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgg

SEQ ID NO: 4835 - DNA, 195 bp, Artificial Sequence
  Synthetic oligonucleotide
aatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggag

SEQ ID NO: 4836 - DNA, 1490 bp, Artificial Sequence
  Synthetic oligonucleotide
gtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgc

SEQ ID NO: 4837 - DNA, 335 bp, Artificial Sequence
  Synthetic oligonucleotide
ctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacag

SEQ ID NO: 4838 - DNA, 200 bp, Artificial Sequence
  Synthetic oligonucleotide
gtgagggtgctctctgcccactgttccagtgcatgtggatttcagcttgtttgcataacacagaggtgggcacactatgctataaggggccaagatagtaaatatttttaggctttataggccatatatctctgtcacattcctcaactctgctgttgtagtatgaaagtatccacaaataatatataaactttatttac

SEQ ID NO: 4839 - DNA, 313 bp, Artificial Sequence
  Synthetic oligonucleotide
gtaaggatccatttaaaaggagagtggcaatacccctccgggtggctgcctacagccagccccaatgggagactctggagtgaaggaatgaagtgctacctccagagataaccaagaagaagaacagaaagtcagccaggaggctgtggacacagcaacaagggcttccagactgcttgagaaggagacagcaggaagctatgagtttgggaactgtatttgcagagcctttgtttcttcactacccagaagtagagttatccagaggggaatgtcagaaaggtagcccaccatatattaaagaggaaagaaa

SEQ ID NO: 4840 - DNA, 210 bp, Artificial Sequence
  Synthetic oligonucleotide
gccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagat

SEQ ID NO: 4841 - DNA, 170 bp, Artificial Sequence
  Synthetic oligonucleotide
gtgagtgtccttgtgctggggttctgaaaaaacctccacctggtattggatttgtaatcccaagctaagattagggcattagtggtattctcagtcttcacagactgcttgttacccaccctcaaaggtagagctgagggacttagattcctcctcagtcccctgcaata

SEQ ID NO: 4842 - DNA, 133 bp, Artificial Sequence
  Synthetic oligonucleotide
gagtttgaccctgaagagttctaccaccttttagaagcagctgagggccacgccaaagagggacaagggattaaatgtgacattccccgctacatcgttagccagctgggcctcacccgggatcccctagaag

SEQ ID NO: 4843 - DNA, 453 bp, Artificial Sequence
  Synthetic oligonucleotide
gtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccag

SEQ ID NO: 4844 - DNA, 180 bp, Artificial Sequence
  Synthetic oligonucleotide
ggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgcca

SEQ ID NO: 4845 - DNA, 916 bp, Artificial Sequence
  Synthetic oligonucleotide
gtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactggcttgcaaaggggacaccccttaaaaccaagcaaaatgctctgagaatagaacagaagagcaacatggggcatagttctggagggaggcagcagctttgccagtttcccttccctctcaccttctcactgtgtgtacagcctccaaagatactgtgcctagtcttgaagctgaagctgaacaaaactgtcctttagtgtttactgggtacatgctgggagttcatagtgttactttactcagaaactaaaagccagtaagaaggaagtaacatgaacagatgttaacatctcagccagatgtgtttacagtatgcagtattcctgtcctaaaaaacattaggctggtacaaaagtaattgcatgtttgccattacttttaataaaggcctgggttccttccctctctggcctgaaaaatgtccatgacagctattagcagattcactttactttccacccccctccataccctgtgtattttcatgctgctaataaaggcataccagagactgggcaatttacaaaag

SEQ ID NO: 4846 - DNA, 139 bp, Artificial Sequence
  Synthetic oligonucleotide
ggggagactgtgccactctgctgaagaatattggggccctgcctgtggacatggtgcgtctatactttgcggaaactgtgctggccctggagtacttacacaactatggcatcgtgcaccgtgacctcaagcctgacaa

SEQ ID NO: 4847 - DNA, 166 bp, Artificial Sequence
  Synthetic oligonucleotide
gtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtg

SEQ ID NO: 4848 - DNA, 532 bp, Artificial Sequence
  Synthetic oligonucleotide
gtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcag

SEQ ID NO: 4849 - DNA, 123 bp, Artificial Sequence
  Synthetic oligonucleotide
gcagtgcctatgaggtgaagcagcacccattctttactggtctggactggacaggacttctccgccagaaggctgaatttattcctcagttggagtcagaggatgatactagctattttgaca

SEQ ID NO: 4850 - DNA, 169 bp, Artificial Sequence
  Synthetic oligonucleotide
gtaaggccaccgatgggtggggtggaggatgggtcctacctgtttgcctagaaacacctgtgcacactgaaattgcattgggagcaacttctcagggctctgctgaaatctaatggggtcacaaggaggccaccagcagggctctgaaggaaagtgtcctttatgtctg

SEQ ID NO: 4851 - DNA, 368 bp, Artificial Sequence
  Synthetic oligonucleotide
gtgtgactgaggaggcccagaatgggcagaacaggctggaggatcagaagaagagggcctgtcaaagggcacacctggggcaggctcagggagttggggttggggccacctctagaaaaagaggagctaagggttggggctacatatagctatatataggtgcttctagaaccactgctgtccctgacatgagatgccaggtcagatcagtggaataactccttccccaaatattcagcaggggtgtgtgaaggagggatggaaccgactggttcaaattcctaggtttccgatgccaaggatgctttatgccacttgggaggtacggctgccagagcccatccccagcgcatcccctgtgcccacag

SEQ ID NO: 4852 - DNA, 251 bp, Artificial Sequence
  Synthetic oligonucleotide
ccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccag

SEQ ID NO: 4853 - DNA, 195 bp, Artificial Sequence
  Synthetic oligonucleotide
ctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcgg

SEQ ID NO: 4854 - DNA, 123 bp, Artificial Sequence
  Synthetic oligonucleotide
cacgtggaggatggaggtccggccagtgaggcagggcttcgtcaaggtgacctcatcacccatgtcaatggggaacctgtgcatggcctggtgcacacggaggtggtggagctgatcctgaag

SEQ ID NO: 4855 - DNA, 137 bp, Artificial Sequence
  Synthetic oligonucleotide
agtggaaacaaggtggccatttcaacaactcccctggagaacacatccattaaagtggggccagctcggaagggcagctacaaggccaagatggcccgaaggagcaagaggagccgcggcaaggatgggcaagaaag

SEQ ID NO: 4856 - DNA, 194 bp, Artificial Sequence
  Synthetic oligonucleotide
cagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcag

SEQ ID NO: 4857 - DNA, 289 bp, Artificial Sequence
  Synthetic oligonucleotide
tgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcag

SEQ ID NO: 4858 - DNA, 256 bp, Artificial Sequence
  Synthetic oligonucleotide
gcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcag

SEQ ID NO: 4859 - DNA, 151 bp, Artificial Sequence
  Synthetic oligonucleotide
cgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggccc

SEQ ID NO: 4860 - DNA, 222 bp, Artificial Sequence
  Synthetic oligonucleotide
ctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacag

SEQ ID NO: 4861 - DNA, 290 bp, Artificial Sequence
  Synthetic oligonucleotide
catgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatctttatgtcttttgcttgcttgttttccttcggtcaacccacatgtaactaggtcctgtgttgctgctgggaatatagtggtgaataaaacagtttccaccaccaggg

SEQ ID NO: 4862 - DNA, 28 bp, Artificial Sequence
  Synthetic oligonucleotide
gtaagcagctgctccctttgtccagcag

SEQ ID NO: 4863 - DNA, 115 bp, Artificial Sequence
  Synthetic oligonucleotide
tgtacatagcagtgtgggacaggtgacttggcagtcgtcaggagaagcatcaaacctggttcgaatgagaaaccagtcccttggacagtctgcaccttctcttactgctggcctg

SEQ ID NO: 4864 - DNA, 32 bp, Artificial Sequence
  Synthetic oligonucleotide
aaggagttgagccttccaagaagaggcagctt

SEQ ID NO: 4865 - DNA, 92 bp, Artificial Sequence
  Synthetic oligonucleotide
ttgtcggacaagtaaccgcaagagcttgattgtgacctctagcacatcacctacactaccacggccacactcaccactccatggccacacag

SEQ ID NO: 4866 - DNA, 76 bp, Artificial Sequence
  Synthetic oligonucleotide
gtaacagtcctttggacagcccccggaatttctctccaaatgcacctgctcacttttcttttgttcctgcccgtag

SEQ ID NO: 4867 - DNA, 21 bp, Artificial Sequence
  Synthetic oligonucleotide
ccatagccacagagctgacag

SEQ ID NO: 4868 - DNA, 79 bp, Artificial Sequence
  Synthetic oligonucleotide
gactgatgggcggcgctggtctttggcctctttgccctcttcaggatatggaactaacactcctagctccactgtctca

SEQ ID NO: 4869 - DNA, 92 bp, Artificial Sequence
  Synthetic oligonucleotide
tcatcatgctcctcacaggaaaagctgcatcagttgcctttccagcctacagctgatgagctgcactttttgacgaagcatttcagcacaga

SEQ ID NO: 4870 - DNA, 44 bp, Artificial Sequence
  Synthetic oligonucleotide
gagcgtaccagatgaggaaggacggcagtccccagccatgcggc

SEQ ID NO: 4871 - DNA, 19 bp, Artificial Sequence
  Synthetic oligonucleotide
ctcgctcccggagcctcag

SEQ ID NO: 4872 - DNA, 76 bp, Artificial Sequence
  Synthetic oligonucleotide
tcccggacgatccccagtatcctttgacagtgaaataataatgatgaatcatgtttacaaagaaagattcccaaag

SEQ ID NO: 4873 - DNA, 101 bp, Artificial Sequence
  Synthetic oligonucleotide
gctcatgagcgctcagagagctcagaagtggctttgtgatgcagctggtgaaaaagctgatgattatcattgcccgcccagcacgtctcctggaatgcctg

SEQ ID NO: 4874 - DNA, 62 bp, Artificial Sequence
  Synthetic oligonucleotide
aaatggcccagttgagcagctgtgacagtcctgacactccagagacagatgattctattgag

SEQ ID NO: 4875 - DNA, 47 bp, Artificial Sequence
  Synthetic oligonucleotide
ggccatggggcatctctgccatctaaaaagacaccctctgaagagga

SEQ ID NO: 4876 - DNA, 39 bp, Artificial Sequence
  Synthetic oligonucleotide
cttcgagaccattaagctcatcagcaatggcgcctatgg

SEQ ID NO: 4877 - DNA, 29 bp, Artificial Sequence
  Synthetic oligonucleotide
cttgtgcatggtgatggagtacgttgaag

SEQ ID NO: 4878 - DNA, 92 bp, Artificial Sequence
  Synthetic oligonucleotide
cctcctaattacatccatggggcacatcaagctcacggactttggactgtccaaaatgggcctcatgagtctgacaacgaacttgtatgagg

SEQ ID NO: 4879 - DNA, 41 bp, Artificial Sequence
  Synthetic oligonucleotide
gtcatattgaaaaggatgcccgggaattcctggacaagcag

SEQ ID NO: 4880 - DNA, 50 bp, Artificial Sequence
  Synthetic oligonucleotide
atgagattgtgtggcctgagggtgatgaggcactgcccccagacgcccag

SEQ ID NO: 4881 - DNA, 52 bp, Artificial Sequence
  Synthetic oligonucleotide
gacctcacctccaaactgctccaccagaaccctctggagagacttggcacag

SEQ ID NO: 4882 - DNA, 6 bp, Artificial Sequence
  Synthetic oligonucleotide
gcccag

SEQ ID NO: 4883 - DNA, 110 bp, Artificial Sequence
  Synthetic oligonucleotide
cccgctcagagcgataccaccacatggactcggaggatgaggaagaagtgagtgaggatggctgccttgagatccgccagttctcttcctgctctccaaggttcaacaag

SEQ ID NO: 4884 - DNA, 87 bp, Artificial Sequence
  Synthetic oligonucleotide
gtgtacagcagcatggagcggctctcactgctcgaggagcgccggacaccacccccgaccaagcgcagcctgagtgaggagaaggag

SEQ ID NO: 4885 - DNA, 61 bp, Artificial Sequence
  Synthetic oligonucleotide
gaccattcagatggcctggcagggctcaaaggccgagaccggagctgggtgattggctccc

SEQ ID NO: 4886 - DNA, 7 bp, Artificial Sequence
  Synthetic oligonucleotide
ctgagat

SEQ ID NO: 4887 - DNA, 33 bp, Artificial Sequence
  Synthetic oligonucleotide
attacggaagcggctgtcggtgtctgagtcgtc

SEQ ID NO: 4888 - DNA, 78 bp, Artificial Sequence
  Synthetic oligonucleotide
aacaccacacctgctccccgttggccagccccatgtccccacattctcagtcgtccaacccatcatcccgggactctt

SEQ ID NO: 4889 - DNA, 6 bp, Artificial Sequence
  Synthetic oligonucleotide
ctccaa

SEQ ID NO: 4890 - DNA, 57 bp, Artificial Sequence
  Synthetic oligonucleotide
gcagggacttcttgccagcccttggcagcatgaggcctcccatcatcatccaccgag

SEQ ID NO: 4891 - DNA, 7 bp, Artificial Sequence
  Synthetic oligonucleotide
ctggcaa

SEQ ID NO: 4892 - DNA, 22 bp, Artificial Sequence
  Synthetic oligonucleotide
gaagtatggcttcaccctgcgg

SEQ ID NO: 4893 - DNA, 57 bp, Artificial Sequence
  Synthetic oligonucleotide
gccattcgcgtctacatgggtgactccgatgtctacaccgtgcaccatatggtgtgg

SEQ ID NO: 4894 - DNA, 39 bp, Artificial Sequence
  Synthetic oligonucleotide
cctgctccctcacgggccctaggcaccctccggcaggac

SEQ ID NO: 4895 - DNA, 8 bp, Artificial Sequence
  Synthetic oligonucleotide
accccatc

SEQ ID NO: 4896 - DNA, 30 bp, Artificial Sequence
  Synthetic oligonucleotide
cctcctgaaggttgctggaaggcccagcac

SEQ ID NO: 4897 - DNA, 25 bp, Artificial Sequence
  Synthetic oligonucleotide
ctccacacccaggcactaacagcac

SEQ ID NO: 4898 - DNA, 27 bp, Artificial Sequence
  Synthetic oligonucleotide
tttctcccagcacttcgggactcaccc

SEQ ID NO: 4899 - DNA, 117 bp, Artificial Sequence
  Synthetic oligonucleotide
ccaccagcagttgctctcctcccagctccacctctgggaagctgagcatgtggtcctggaaatcccttattgagggcccagacagggcatccccaagcagaaaggcaaccatggcag

SEQ ID NO: 4900 - DNA, 85 bp, Artificial Sequence
  Synthetic oligonucleotide
gtgggctagccaacctccaggatttggaaaacacaactccagcccagcctaagaacctgtctcccagggagcaggggaagacaca

SEQ ID NO: 4901 - DNA, 24 bp, Artificial Sequence
  Synthetic oligonucleotide
gccacctagtgcccccagactggc

SEQ ID NO: 4902 - DNA, 79 bp, Artificial Sequence
  Synthetic oligonucleotide
ccatccatcttatgaggatcccagccagggctggctatgggagtctgagtgtgcacaagcagtgaaagaggatccagcc

SEQ ID NO: 4903 - DNA, 11 bp, Artificial Sequence
  Synthetic oligonucleotide
ctgagcatcac

SEQ ID NO: 4904 - DNA, 41 bp, Artificial Sequence
  Synthetic oligonucleotide
ccaagtgcctgatgcctcaggtgacagaaggcaggacgttc

SEQ ID NO: 4905 - DNA, 665 bp, Artificial Sequence
  Synthetic oligonucleotide
gagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaac

SEQ ID NO: 4906 - DNA, 513 bp, Artificial Sequence
  Synthetic oligonucleotide
cccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctgggcttcagaaaccggaacaacaacactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtcgccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcag

SEQ ID NO: 4907 - DNA, 437 bp, Artificial Sequence
  Synthetic oligonucleotide
gagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaag

SEQ ID NO: 4908 - DNA, 517 bp, Artificial Sequence
  Synthetic oligonucleotide
tgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaac

SEQ ID NO: 4909 - DNA, 132 bp, Artificial Sequence
  Synthetic oligonucleotide
gaagaagacgaggagaggagggaagagagggctgaggttggggccccactgagcccagaccacagcgaggaggaagaggaggaggaggaggggctggaggaagatgagccccgcttcaccatcatccccaac

SEQ ID NO: 4910 - DNA, 251 bp, Artificial Sequence
  Synthetic oligonucleotide
gtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccag

SEQ ID NO: 4911 - DNA, 327 bp, Artificial Sequence
  Synthetic oligonucleotide
gtgagcatgggcggggccctggaaaaacctgaggaaggtgccgggcccagcgtggtgaatcctggtgggggcggagcctggcccggtaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattca

SEQ ID NO: 4912 - DNA, 242 bp, Artificial Sequence
  Synthetic oligonucleotide
ggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggc

SEQ ID NO: 4913 - DNA, 31 bp, Artificial Sequence
  Synthetic oligonucleotide
ctgagcacaggcaccacctccccagccacag

SEQ ID NO: 4914 - DNA, 30 bp, Artificial Sequence
  Synthetic oligonucleotide
aagatgacaatgatgatgatgatgtctcca

SEQ ID NO: 4915 - DNA, 87 bp, Artificial Sequence
  Synthetic oligonucleotide
ctgagtatggacaccaggcccacaggcaccaagaccacagaaaggaagaggttgaggctgtctcaggtgaacaccaccatcatgtcc

SEQ ID NO: 4916 - DNA, 10 bp, Artificial Sequence
  Synthetic oligonucleotide
ctgaccacag

SEQ ID NO: 4917 - DNA, 45 bp, Artificial Sequence
  Synthetic oligonucleotide
gcaccaaggccacagagacgaggaagaagatgaggatgtgtccac

SEQ ID NO: 4918 - DNA, 18 bp, Artificial Sequence
  Synthetic oligonucleotide
caggaggaggaagaagag

SEQ ID NO: 4919 - DNA, 9 bp, Artificial Sequence
  Synthetic oligonucleotide
gaagacaag

SEQ ID NO: 4920 - DNA, 15 bp, Artificial Sequence
  Synthetic oligonucleotide
gaggaggaggaggag

SEQ ID NO: 4921 - DNA, 64 bp, Artificial Sequence
  Synthetic oligonucleotide
ccactggacaggagagaggaggctggaggtgcctccagcgaggaggaaagcggtgaggacacag

SEQ ID NO: 4922 - DNA, 71 bp, Artificial Sequence
  Synthetic oligonucleotide
gtccacaggatgctcaggagtatgggaactaccagccagggtccctgtgtggctactgctccttctgcaat

SEQ ID NO: 4923 - DNA, 69 bp, Artificial Sequence
  Synthetic oligonucleotide
cgatgcactgaatgtgagagctgtcactgtgatgaggagaacatgggtgagcactgcgaccagtgccag

SEQ ID NO: 4924 - DNA, 55 bp, Artificial Sequence
  Synthetic oligonucleotide
cactgtcagttctgctatctctgcccgctggtctgcgaaacggtctgcgctccag

SEQ ID NO: 4925 - DNA, 8 bp, Artificial Sequence
  Synthetic oligonucleotide
gaagctac

SEQ ID NO: 4926 - DNA, 29 bp, Artificial Sequence
  Synthetic oligonucleotide
gttgactatttctcctcgtccctttatca

SEQ ID NO: 4927 - DNA, 214 bp, Artificial Sequence
  Synthetic oligonucleotide
gggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaag

SEQ ID NO: 4928 - DNA, 122 bp, Artificial Sequence
  Synthetic oligonucleotide
acggtgactgtgaaggaggaccaggtgttgcagcagaacccacccaagttcgacaagattgaggacatggccatgctgaccttcctgcacgagcccgcggtgcttttcaacctcaaggagcg

SEQ ID NO: 4929 - DNA, 157 bp, Artificial Sequence
  Synthetic oligonucleotide
acctactcgggcctcttctgtgtcactgtcaacccctacaagtggctgccggtgtacaatgccgaagtggtggccgcctacaggggcaagaagaggagtgaggccccgccccacatcttctccatctccgacaacgcctatcagtacatgctgacag

SEQ ID NO: 4930 - DNA, 269 bp, Artificial Sequence
  Synthetic oligonucleotide
atgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgac

SEQ ID NO: 4931 - DNA, 171 bp, Artificial Sequence
  Synthetic oligonucleotide
ttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaag

SEQ ID NO: 4932 - DNA, 310 bp, Artificial Sequence
  Synthetic oligonucleotide
cccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactg

SEQ ID NO: 4933 - DNA, 124 bp, Artificial Sequence
  Synthetic oligonucleotide
gtatcgcatcctgaacccagtggccatccctgagggacagttcattgatagcaggaaggggacagagaagctgctcagctctctggacattgatcacaaccagtacaagtttggccacaccaag

SEQ ID NO: 4934 - DNA, 137 bp, Artificial Sequence
  Synthetic oligonucleotide
gtgttcttcaaggcagggctgcttgggctgctggaggagatgcgggatgagaggctgagccgcatcatcacgcgcatgcaggcccaagcccggggccagctcatgcgcattgagttcaagaagatagtggaacgcag

SEQ ID NO: 4935 - DNA, 256 bp, Artificial Sequence
  Synthetic oligonucleotide
ggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcg

SEQ ID NO: 4936 - DNA, 243 bp, Artificial Sequence
  Synthetic oligonucleotide
gaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaag

SEQ ID NO: 4937 - DNA, 177 bp, Artificial Sequence
  Synthetic oligonucleotide
gtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgat

SEQ ID NO: 4938 - DNA, 146 bp, Artificial Sequence
  Synthetic oligonucleotide
ctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaa

SEQ ID NO: 4939 - DNA, 270 bp, Artificial Sequence
  Synthetic oligonucleotide
gcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgag

SEQ ID NO: 4940 - DNA, 184 bp, Artificial Sequence
  Synthetic oligonucleotide
aaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaag

SEQ ID NO: 4941 - DNA, 166 bp, Artificial Sequence
  Synthetic oligonucleotide
atcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcagg

SEQ ID NO: 4942 - DNA, 135 bp, Artificial Sequence
  Synthetic oligonucleotide
gaggagggcaagatcctccgggcccagctagagttcaaccagatcaaggcagagatcgagcggaagctggcagagaaggacgaggagatggaacaggccaagcgcaaccaccagcgggtggtggactcgctgcag

SEQ ID NO: 4943 - DNA, 129 bp, Artificial Sequence
  Synthetic oligonucleotide
acctccctggatgcagagacacgcagccgcaacgaggtcctgagggtgaagaagaagatggaaggagacctcaatgagatggagatccagctcagccacgccaaccgcatggccgccgaggcccagaag

SEQ ID NO: 4944 - DNA, 204 bp, Artificial Sequence
  Synthetic oligonucleotide
gacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccag

SEQ ID NO: 4945 - DNA, 276 bp, Artificial Sequence
  Synthetic oligonucleotide
gccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccag

SEQ ID NO: 4946 - DNA, 224 bp, Artificial Sequence
  Synthetic oligonucleotide
gtgcggcggacgccagacaccgggagtagatgtggaagtttcttctctggccccactgccccgccctcacagggctcctctcacctcctccttgagatgctgttggtagatttaacgttcttctcacgctctgcagtcagtttgacttgagtctatgagtttttccagcaaatgaagaatctacttctacttcctgaaaactcttctaactagtctttccccag

SEQ ID NO: 4947 - DNA, 135 bp, Artificial Sequence
  Synthetic oligonucleotide
gaggagcaagccaacaccaacctgtccaagttccgcaaggtgcagcatgagctggatgaggcagaggagcgggcggacatcgctgagtcccaggtcaacaagcttcgagccaagagccgtgacattggtgccaag

SEQ ID NO: 4948 - DNA, 1927 bp, Artificial Sequence
  Synthetic oligonucleotide
caaaaaatgcacgatgaggagtgacactgcctcgggaacctcactcttgccaacctgtaataaatatgagtgccaaactctgcctgagcccatctgtccttcctgccagctgtccatcctggatcagggcagtagggggcctgagaggagggaggcccccagcccctgtatcagagctgccagagccaaggcatcccatatccacaaggaaggagaccgaggtgcagaggagtgaggtgttctgcctgacgtggacagctgtgagtcccagttctgctcagtcaaccacacaagggtggagagggagaaatttcaaaagtgaagaaaacaatggcatcaaaatggtgagccagtccaagatgctacgagatagaattttggtgccgaagttgaagccactctccacctaccccacccctgaggctgcaatgattaaaggtgtcctaggacacccattctttctgaaatgaattttccaccaatgccagaaaaggctcagagctggctgagaattaaggtatgggaaaggagatgggagagattccattctagtcagcccctaggaagtaactcccagggagccccctccctgtcttccccaggggtctccccctgcctcctatgattcagcacctcaccgtgagggcatcttgagactctggggccaatcaacactgagcccaaaccaatatgccatgaggaccaagcctgggcattgctcatttcatgttggttctcacacagacacagatggcacaggtgcctgtacagggaaacactgtggtcacatttctgctctctctaagctcctactggggacagtctggcctggatcacacagctgcttgtgggacaggcccggtcctgaccccgttctgcacaaagcaaatccccactccccactgggctttgcagccaggctctgctgaccgcctccttaaccgttcacctggcaccccatctccctgactccccaagtggagcctcttctatccctcctctgagaccatgagaatggactgtgcataaagccctgagaaatgtgagcagtgaccagagaaacacaaaatcctgttggttctagcccaggagaggctgccagttctgatggtgagccaggacacaaggataggagaacaggaagcaggaggcaggaaaaagaccaagagagaggagtggctgccaccaaggaagcagagcgctctgaccagagttcaagatccagggttcgggcaggacttgggagctggggcctgcagctggaaggagcgctccagaagaaggattgtatctcagggcgggaacacacacacatcagcgacaggagatagcacgtcagctgggatggagctgctgagccaggccatgctgggctcctcgggctgggcaggaacgtctggctgcacatctgtctgtctcggcccagcagggctgactcccgggctgtggcagtgtctgctccaaactcccctgggccttcccatagcattcactgtggggagctcttgaccagcttgtctctttcccagcctgtgagtgctaaagggcaggccccccgtcacctctgaggccctggcacccagcacagtgtgcatgggagatgctcaggaaatgtgtgctgaggagctggcaagctgggagggtggacccgcagtggagggaagagttggccattcttttctgagctacaaggaggctcagtacagtatccagaacactcgcttaggtgtcagaagagctgcgttctggccctagctctgtcacaaatgagttcacctcccctggctgggcctgttttctcttatgtgaaatgagggcattggaccagctgataatcaacggctctcccagcattcgcattttgggaaatctctccctcctctgatacctcaggctgccctctccctgcctcctgttcctgtcatag

SEQ ID NO: 4949 - DNA, 31 bp, Artificial Sequence
  Synthetic oligonucleotide
gaggacagatagagagactcctgcggcccag

SEQ ID NO: 4950 - DNA, 33 bp, Artificial Sequence
  Synthetic oligonucleotide
attcttcaggattctccgtgaagggataaccag

SEQ ID NO: 4951 - DNA, 22 bp, Artificial Sequence
  Synthetic oligonucleotide
ctacgcggcctggatgatatat

SEQ ID NO: 4952 - DNA, 28 bp, Artificial Sequence
  Synthetic oligonucleotide
atcgggagaaccagtccatcctcatcac

SEQ ID NO: 4953 - DNA, 112 bp, Artificial Sequence
  Synthetic oligonucleotide
gggagaatccggggcggggaagactgtgaacaccaagcgtgtcatccagtactttgccagcattgcagccataggtgaccgtggcaagaaggacaatgccaatgcgaacaag

SEQ ID NO: 4954 - DNA, 93 bp, Artificial Sequence
  Synthetic oligonucleotide
ggcaccctggaggaccagatcatccaggccaaccccgctctggaggccttcggcaatgccaagactgtccggaacgacaactcctcccgcttt

SEQ ID NO: 4955 - DNA, 64 bp, Artificial Sequence
  Synthetic oligonucleotide
gggaaattcattaggatccactttggggccactggaaagctggcttctgcagacatagagacct

SEQ ID NO: 4956 - DNA, 99 bp, Artificial Sequence
  Synthetic oligonucleotide
acctgctggagaagtcccgggtgatcttccagctgaaagctgagagaaactaccacatcttctaccagattctgtccaacaagaagccggagttgctgg

SEQ ID NO: 4957 - DNA, 104 bp, Artificial Sequence
  Synthetic oligonucleotide
acatgctgctggtcaccaacaatccctacgactacgccttcgtgtctcagggagaggtgtccgtggcctccattgatgactccgaggagctcatggccaccgat

SEQ ID NO: 4958 - DNA, 117 bp, Artificial Sequence
  Synthetic oligonucleotide
agtgcctttgacgtgctgggcttcacttcagaggagaaagctggcgtctacaagctgacgggagccatcatgcactacgggaacatgaagttcaagcagaagcagcgggaggagcag

SEQ ID NO: 4959 - DNA, 22 bp, Artificial Sequence
  Synthetic oligonucleotide
gcggagccagacggcaccgaag

SEQ ID NO: 4960 - DNA, 71 bp, Artificial Sequence
  Synthetic oligonucleotide
gggacagtggtaaaagcaaaggaggcaagaaaaagggctcatccttccagacggtgtcggctctccaccgg

SEQ ID NO: 4961 - DNA, 88 bp, Artificial Sequence
  Synthetic oligonucleotide
gaaaatctcaacaagctaatgaccaacctgaggaccacccatcctcactttgtgcgttgcatcatccccaatgagcggaaggctccag

SEQ ID NO: 4962 - DNA, 118 bp, Artificial Sequence
  Synthetic oligonucleotide
gggtgatggacaaccccctggtcatgcaccagctgcgctgcaatggcgtgctggagggcatccgcatctgcaggaagggcttccccaaccgcatcctctacggggacttccggcagag

SEQ ID NO: 4963 - DNA, 91 bp, Artificial Sequence
  Synthetic oligonucleotide
gaaggagtttgacattaatcagcagaacagtaagattgaggatgagcaggcgctggcccttcaactacagaagaaactgaaggaaaaccag

SEQ ID NO: 4964 - DNA, 12 bp, Artificial Sequence
  Synthetic oligonucleotide
ctgggcgagcag

SEQ ID NO: 4965 - DNA, 30 bp, Artificial Sequence
  Synthetic oligonucleotide
atcgacaacctgcagcgggtgaagcagaag

SEQ ID NO: 4966 - DNA, 78 bp, Artificial Sequence
  Synthetic oligonucleotide
ctggagaaggagaagagcgagttcaagctggagctggatgacgtcacctccaacatggagcagatcatcaaggccaag

SEQ ID NO: 4967 - DNA, 102 bp, Artificial Sequence
  Synthetic oligonucleotide
gcaaacctggagaaagtgtctcggacgctggaggaccaggccaatgagtaccgcgtgaagctagaagaggcccaacgctccctcaatgatttcaccacccag

SEQ ID NO: 4968 - DNA, 25 bp, Artificial Sequence
  Synthetic oligonucleotide
cgagccaagctgcagaccgagaatg

SEQ ID NO: 4969 - DNA, 119 bp, Artificial Sequence
  Synthetic oligonucleotide
gagagttggcccggcagctagaggaaaaggaggcgctaatctcgcagctgacccgggggaagctctcttatacccagcaaatggaggacctcaaaaggcagctggaggaggagggcaag

SEQ ID NO: 4970 - DNA, 24 bp, Artificial Sequence
  Synthetic oligonucleotide
gcgaagaacgccctggcccatgca

SEQ ID NO: 4971 - DNA, 66 bp, Artificial Sequence
  Synthetic oligonucleotide
ctgcagtcggcccggcatgactgcgacctgctgcgggagcagtacgaggaggagacagaggccaag

SEQ ID NO: 4972 - DNA, 72 bp, Artificial Sequence
  Synthetic oligonucleotide
gccgagctgcagcgcgtcctgtccaaggccaactcggaggtggcccagtggaggaccaagtatgagacggac

SEQ ID NO: 4973 - DNA, 35 bp, Artificial Sequence
  Synthetic oligonucleotide
gccattcagcggactgaggagctcgaagaggccaa

SEQ ID NO: 4974 - DNA, 77 bp, Artificial Sequence
  Synthetic oligonucleotide
aggaaatctcggaccttactgagcagctaggagaaggaggaaagaatgtgcatgagctggagaaggtccgcaaacag

SEQ ID NO: 4975 - DNA, 21 bp, Artificial Sequence
  Synthetic oligonucleotide
ctggaggtggagaagctggag

SEQ ID NO: 4976 - DNA, 27 bp, Artificial Sequence
  Synthetic oligonucleotide
ctgcagtcagccctggaggaggcagag

SEQ ID NO: 4977 - DNA, 15 bp, Artificial Sequence
  Synthetic oligonucleotide
gcctccctggagcac

SEQ ID NO: 4978 - DNA, 30 bp, Artificial Sequence
  Synthetic oligonucleotide
caagtcaagagcctccagagcttgctgaag

SEQ ID NO: 4979 - DNA, 57 bp, Artificial Sequence
  Synthetic oligonucleotide
aacaccagcctcatcaaccagaagaagaagatggagtcggatctgacccagctccag

SEQ ID NO: 4980 - DNA, 69 bp, Artificial Sequence
  Synthetic oligonucleotide
tcggaagtggaggaggcagtgcaggagtgcagaaacgccgaggagaaggccaagaaggccatcacggat

SEQ ID NO: 4981 - DNA, 96 bp, Artificial Sequence
  Synthetic oligonucleotide
acagaggaagacaaaaagaacctgctgcggctacaggacctggtggacaagctgcaactgaaggtcaaggcctacaagcgccaggccgaggaggcg

SEQ ID NO: 4982 - DNA, 359 bp, Artificial Sequence
  Synthetic oligonucleotide
ggaggtcaggagggaggcgtggacaagggtccggccgtagctggtcccgtcctggaagctgcttaagttcctggttcccaccggggccaagagtgatacctgatcctgggggattgtgaaatgacctcatgtggcagcccgcccgcggtgcccgcaaagccctccaccctccccttccccgctcggctccacccctaccccacgccccctcccgcgcgcgcggttaaatccccgcacctgagcatcggctcacacctgcaccccgcccgggcatagcaccatgcctgcttgtcgcctaggcccgctagccgccgccctcctcctcagcctgctgctgttcggcttcaccctagtctcag

SEQ ID NO: 4983 - DNA, 144 bp, Artificial Sequence
  Synthetic oligonucleotide
gcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatg

SEQ ID NO: 4984 - DNA, 388 bp, Artificial Sequence
  Synthetic oligonucleotide
ctctggtgcatgacgggcttccgggcacgcacagccgggacattgttccccgcggcctggggacccggggccgcagtttccttctcgaaccggccgaagcctgccctgcgggaaagcccggagcctggggcgctcacctctcctcttggagtccctccctgggggcctcccccagccctggggaaagactgggagagcctggcctggcaagattttccccaattcctctgtccaggcggaaaggaactttacagatttaggaaaatgccccgctcatcttaaagatgtgtaagggagcatcggtgagaaaaaaatgttcttgcccaaggtcacaccgccatcccatggctgctggagtcatagtgagggttcagcttttgcctttcag

SEQ ID NO: 4985 - DNA, 129 bp, Artificial Sequence
  Synthetic oligonucleotide
gccaactggctgagtgattcgaagaaagtgaggaatcctccctggacactgtatcgcccttcgtcgtctttcagtcaatctcttccactctaaggattgagtgagcgcgagctggggactctctcaaag

SEQ ID NO: 4986 - DNA, 136 bp, Artificial Sequence
  Synthetic oligonucleotide
gtgcttgctggagctgcagtctccaccaggctatcagaacagggggtggcttaaacagcatggaatctcagctttccgttctccagaggaaaatgctgaggattagaggcagggataggacctggagagaaccaag

SEQ ID NO: 4987 - DNA, 928 bp, Artificial Sequence
  Synthetic oligonucleotide
ctcccaggtgcaagcgattctcctgcctcagcctcccaagtagctgggattaccggtgcatgccaccacgcccagttaacttttttgtatttttagtagagcggggggtctcgagtcctgacctccgatgatcccacccgcctgagcctcccaaagtgtgggattacaggcatgagccactgcacccggtgatctgtcagccactttccttgtcctctacagctaatcacccagttctgtgcctgtgttttacacacaaaaacctgcacatatttatagcagctttatttataattgccaaaagttggaagcaaccatgatgtacctcagttgatgaatggatttggctgggcctggctcccctctatctaacctgggaagtggagtgtgattgtgtgtgtgtttgttagtggaaggacgtgtggtttctctctgcatggatgaatgagtgtatttggagggtcatggtgctgagagactgcaactgggattcggtctgtgggtatgagtgaagattataagtgtgtaacccctcacatgtgtactgtactttacactttaagtggcagcatagtgcttaaccatggcagcagcagttaacacatagactctgcagctagatttcttggggttcaaattctgcctcaattctgtgtgaccttaggcaaattacttaacttctcagtgcctcagtttcctcacttgtaacacaaggaaatattaacagatccctccccttcttttaggattattgtgagaattagaagagttaatatatgttaggggcttgatacctggcatgtaataagagctaattaagtgttcactgttataatttctcataactacagagtagtttgatatttcagggagaaataatatatgtttgtttcccactgctttcacaacaaccctatgttgtaattag

SEQ ID NO: 4988 - DNA, 128 bp, Artificial Sequence
  Synthetic oligonucleotide
cactgttccactggcacctaaagacacggaggctctgggagatttctggccctaggccacgaaggcccacttgggactcaagctgaggtcctgtgattccatttgggagcaggaggagggatttgcag

SEQ ID NO: 4989 - DNA, 172 bp, Artificial Sequence
  Synthetic oligonucleotide
gtgatcttcctgggcctcctgagagcagctcaggtgcccaagatggactcaggcaggcagctctgctgtatgtgaagcccagtgaggggcagtgggggggccatgctgcaggtacaagttaatctccctgtatcgcctctgcccacttacccttactcctttttctacccag

SEQ ID NO: 4990 - DNA, 153 bp, Artificial Sequence
  Synthetic oligonucleotide
ataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgag

SEQ ID NO: 4991 - DNA, 864 bp, Artificial Sequence
  Synthetic oligonucleotide
ctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcaaaaaaagtctctgtctcccctgacttgggttgaggtgggtgggcaagtgttaagggtgtgaccagatcatccaggcatgaagtccagagaaggatcatctggtaggtgttagcattctcctggtggatccctgcatcaaccctatgaatctggtcattattcctccaggaggatggatgagaaaaacgaggctcagacaggtggtggggtgcttccaaagtcactcagattcattgctgggggtgctgataagcagcagcatgcaccaggtgccagacacggtgctgggaggtttgcttatgagatcctctgggtcctcaaaacaatccccagagcagttaacaacatacccctgtcatagacctggactccatgaggttacttgccagtggccacacagaaagatggcaatccaggatcctctcttgttgatactttaagtcaaagttttattttatataagtaatatagtcatatgcatccaaactcaaaagattaaaaaaagatatacaatgaaaagtgtctttcaccctttatcccctgtctccaccttccaccccagccaccaagttgttttctataaagacaaaaaatgttctcagtttcttgggtttcttttcagatatgtatccccagctctcaatcctttctctctcccttctctatttcttcctcttttcctttctattccccctctatgcc

SEQ ID NO: 4992 - DNA, 564 bp, Artificial Sequence
  Synthetic oligonucleotide
gacgtcgtcccaggagggggactgaggagttcacattgattcagcccatgctctacccagacaccgccgcactctgtgcatttgtcaactcactttgtcctcgtgcccttagtatttccattttaccactagggaatggagagacagagaggccgatgttctgatcaaagcctctcacctcctgagtggagtatctgaggctccccctgggcttctaaagagtcgactctcttagccgttaaggttcagggcacatgggtggcagtgctggcactgctagtcctcggagcatgtctcctcacgcacctgctgttcttctccctaagaaagtcgttcactagaggctaccggcgtgggaattgttccatttcctgaagtgcatctgaacatgggcagccagaaggaggtctctcgctaatcagcccctagaaaccaacaagggccaaccaggttccttggggtcatgtcctctcttcccatgagggacagccccagacggaacatggtcctcgctgggatggccttggctcactgagtcttcccccacccccgcctgcctctgcc

SEQ ID NO: 4993 - DNA, 419 bp, Artificial Sequence
  Synthetic oligonucleotide
ctcttgccagactgcccccaaagagagaatcgcctcctttcttagtggttatttgcacccttcaccggcatcttaagaaaggcatgaagcacctttcagcaaaatatacgacaataccttcttttttttctttttttctttttttgagacgaagtttcactcttgtcgcccaggctggagtgcagtggtgtgatctcgactcactgcaacctccgcctctctgggttcaagcaattatccagcctcagcctcccgagtagctgggactacaggcgtgtgccaccatgcccagctgattatttttagtagagatggggtttcaccatgttggtcaggctggtctcgaactcctgacctcaggtaatctgcctgccttggcctcccaaagtgctgggattacaggcgtgagccactgtgcc

SEQ ID NO: 4994 - DNA, 493 bp, Artificial Sequence
  Synthetic oligonucleotide
cagccaagatataacaatacgttttaaaatagaatattaacactttgggaggccgaggcaggcggatcgcaccacagcactctagcctaagcaacagagcaagactccatctcaaaagaaaaaaaaaagagtattaaataacatacacacaaagacaaatgcaaaagtactaacctgtatggactaggactataggaaaacctggaatttgagcattaaatttggctctgagcttactttcccaccctgaaagttctccaaggaaaatgcttgtgcagctgactgccaacccccccagattcctcacgtcccgcacccttctcattatctggcctgcatctctcctgcttcagcaccttctgactcgtttggcctcctggatgccattctccttgtcatttttcttggactgggtgacccatgtctctccctttccctcagccttccttcagatcaaaccaccctgatcctcatgtttcttcctatctcctag

SEQ ID NO: 4995 - DNA, 366 bp, Artificial Sequence
  Synthetic oligonucleotide
tttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggaatgg

SEQ ID NO: 4996 - DNA, 68 bp, Artificial Sequence
  Synthetic oligonucleotide
cttttcccggcacatgcgcaccgcagcgggtcgcgcgccctaaggagtggcactttttaaaagtgcag

SEQ ID NO: 4997 - DNA, 38 bp, Artificial Sequence
  Synthetic oligonucleotide
ccggagaccagcctacagccgcctgcatctgtatccag

SEQ ID NO: 4998 - DNA, 114 bp, Artificial Sequence
  Synthetic oligonucleotide
cgccaggtcccgccagtcccagctgcgcgcgccccccagtcccgcacccgttcggcccaggctaagttagccctcaccatgccggtcaaaggaggcaccaagtgcatcaaatac

SEQ ID NO: 4999 - DNA, 30 bp, Artificial Sequence
  Synthetic oligonucleotide
ctgctgttcggatttaacttcatcttctgg

SEQ ID NO: 5000 - DNA, 109 bp, Artificial Sequence
  Synthetic oligonucleotide
cttgccgggattgctgtccttgccattggactatggctccgattcgactctcagaccaagagcatcttcgagcaagaaactaataataataattccagcttctacacag

SEQ ID NO: 5001 - DNA, 98 bp, Artificial Sequence
  Synthetic oligonucleotide
gagtctatattctgatcggagccggcgccctcatgatgctggtgggcttcctgggctgctgcggggctgtgcaggagtcccagtgcatgctgggactg

SEQ ID NO: 5002 - DNA, 75 bp, Artificial Sequence
  Synthetic oligonucleotide
ttcttcggcttcctcttggtgatattcgccattgaaatagctgcggccatctggggatattcccacaaggatgag

SEQ ID NO: 5003 - DNA, 99 bp, Artificial Sequence
  Synthetic oligonucleotide
gtgattaaggaagtccaggagttttacaaggacacctacaacaagctgaaaaccaaggatgagccccagcgggaaacgctgaaagccatccactatgcg

SEQ ID NO: 5004 - DNA, 5 bp, Artificial Sequence
  Synthetic oligonucleotide
ttgaa

SEQ ID NO: 5005 - DNA, 85 bp, Artificial Sequence
  Synthetic oligonucleotide
ctgctgtggtttggctgggggcgtggaacagtttatctcagacatctgccccaagaaggacgtactcgaaaccttcaccgtgaag

SEQ ID NO: 5006 - DNA, 84 bp, Artificial Sequence
  Synthetic oligonucleotide
tcctgtcctgatgccatcaaagaggtcttcgacaataaattccacatcatcggcgcagtgggcatcggcattgccgtggtcatg

SEQ ID NO: 5007 - DNA, 11 bp, Artificial Sequence
  Synthetic oligonucleotide
gtgagtggcag

SEQ ID NO: 5008 - DNA, 47 bp, Artificial Sequence
  Synthetic oligonucleotide
atatttggcatgatcttcagtatgatcttgtgctgtgctatccgcag

SEQ ID NO: 5009 - DNA, 36 bp, Artificial Sequence
  Synthetic oligonucleotide
gaaccgcgagatggtctagagtcagcttacatccct

SEQ ID NO: 5010 - DNA, 44 bp, Artificial Sequence
  Synthetic oligonucleotide
gagcaggaaagtttacccatgaagattggtgggattttttgttt

SEQ ID NO: 5011 - DNA, 15 bp, Artificial Sequence
  Synthetic oligonucleotide
gtttgttttgttttg

SEQ ID NO: 5012 - DNA, 153 bp, Artificial Sequence
  Synthetic oligonucleotide
gtgggctcagggttccagggtggctggaccccaggccccagctctgcagcagggaggacgtggctgggctcgtgaagcatgtgggggtgagcccaggggccccaaggcagggcacctggccttcagcctgcctcagccctgcctgtcacccag

SEQ ID NO: 5013 - DNA, 525 bp, Artificial Sequence
  Synthetic oligonucleotide
ctggagaactactgcaactagacgcagcccgcaggcagccccacacccgccgcctcctgcaccgagagagatggaataaagcccttgaaccagcactgctgtgccgtctgtgtgtcttgggggccctgggccaagccccacttcccggcactgttgtgagcccctcccagctctctccacgctctctgggtgcccacaggtgccaacgccggccaggcccagcatgcagtggctctccccaaagcggccatgcctgtcggctgcctgctgcccccaccctgtggctcagggtccagtatgggagctgcgggggtctctgaggggccaggggtggtggggccactgaggagtgacttcttgttcagtagctctggactcttggagtccccagagaccttgttcaggaaagggaatgagaacattccagcaattttccccccacctagccctcccaggttctatttttagagttatttctgatggagtccctgtggagggaggaggctgggctgagggagggggtcc

SEQ ID NO: 5014 - DNA, 110 bp, Artificial Sequence
  Synthetic oligonucleotide
ggcaggggttgagaggtaggggagatgggctctgagactataaagccagcgggggcccagcagccctcagccctccaggacaggctgcatcagaagaggccatcaagcag

SEQ ID NO: 5015 - DNA, 30 bp, Artificial Sequence
  Synthetic oligonucleotide
gtctttgcgttccaagggcctttgcgtcag

SEQ ID NO: 5016 - DNA, 106 bp, Artificial Sequence
  Synthetic oligonucleotide
atcactgtccttctgccatggccctgtggatgcgcctcctgcccctgctggcgctgctggccctctggggacctgacccagccgcagcctttgtgaaccaacacct

SEQ ID NO: 5017 - DNA, 11 bp, Artificial Sequence
  Synthetic oligonucleotide
gtgcggctcac

SEQ ID NO: 5018 - DNA, 64 bp, Artificial Sequence
  Synthetic oligonucleotide
acctggtggaagctctctacctagtgtgcggggaacgaggcttcttctacacacccaagacccg

SEQ ID NO: 5019 - DNA, 23 bp, Artificial Sequence
  Synthetic oligonucleotide
ccgggaggcagaggacctgcagg

SEQ ID NO: 5020 - DNA, 8 bp, Artificial Sequence
  Synthetic oligonucleotide
tggggcag

SEQ ID NO: 5021 - DNA, 28 bp, Artificial Sequence
  Synthetic oligonucleotide
gtggagctgggcgggggccctggtgcag

SEQ ID NO: 5022 - DNA, 89 bp, Artificial Sequence
  Synthetic oligonucleotide
gcagcctgcagcccttggccctggaggggtccctgcagaagcgtggcattgtggaacaatgctgtaccagcatctgctccctctaccag

SEQ ID NO: 5023 - DNA, 573 bp, Artificial Sequence
  Synthetic oligonucleotide
gctgctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgccgccactatgctctccctccgtgtcccgctcgcgcccatcacggacccgcagcagctgcagctctcgccgctgaaggggctcagcttggtcgacaaggagaacacg

SEQ ID NO: 5024 - DNA, 134 bp, Artificial Sequence
  Synthetic oligonucleotide
gtgaacgtgttgtagcctttgctgcagtggaaggcattttcttttccggttcttttgcgtcgatattctggctcaagaaacgaggactgatgcctggcctcacattttctaatgaacttattagcagagatgag

SEQ ID NO: 5025 - DNA, 121 bp, Artificial Sequence
  Synthetic oligonucleotide
gggatgagaagctcgggaaggtctgaccagccttacgtcttgaaagggaatcccctgcttctgcgtgtcaggtgttactcggggtgcgccagtggaagcgggaggcagttgcagctttcag

SEQ ID NO: 5026 - DNA, 1278 bp, Artificial Sequence
  Synthetic oligonucleotide
tccagaatgcctcctttctgcctaaacgcctctgatcttcatttgatcatcagcagctgcagacccatgagccactgggcctgacctgggagacactggccctccacttccagtgctctccagctggatttcctccagaacagtggcaaagagttcgcccagagctgcgtcccctccctgggaagcagcgctgagtcagggttacctggctccactgtgcccctagcgaggtgaaagttcgcacaatgacatgggctctctgttgaggataaggaggctacagcccaaggagcttgtgcaccgcaggcagagccactcaggtcatcttccagagcgggatgtctgactccagagcccgccagcccacactgctctcctgaggactgggtttctctggcctgagtctgcctgagtctacaggaagaaccctgctggcaccccagtaagcccctctagaccttggagctctaactgctctcagagctcacttttcagttagcctgtaaggcaggggtgtccaatcttttggcttcccttggccacattggaaggagaattggcttgtgtcacacataaaatacactaacactaacgatagctgatgagctaaaaacaattaaaaatcacaaactcataatgttttaagaaagtttataaatttgtgttgggccacattcaaagccgttctgggctacgggttggacaagcttgctataatggatcagagatatgtacagtcttaaagaagaaacagctcccaggcctgtaagacctatcagggcactcactgaatgctgtgagcaggggaaggggcagtcctgggcagtggggtcctctctgggggtccagctgtgtctccagtcgtctggggagctgggaacagcacaccagggttcttgcctcctgggaaagttctcacagaaagagagaacagaggtgcaaaagctaggccatgttcattattctttcattccctacttattgagctttgacaatgtgtgagggactgcttgattgattgactgattgattgggacagggtctctgtcacctaggctggagtgcagtggtgcaacctcagctccctgtaacttccgcctcctgggctcaagccatcctcctacctcagcctcctgagtagctgggattacaggcccacgccaccacacccggctactttttgtattttttggtagagacagggtttcgctatgctgccaggctggtcttgaacaaccaggctcgagtgatccttctgcctccccttgggctcccaaa

SEQ ID NO: 5027 - DNA, 375 bp, Artificial Sequence
  Synthetic oligonucleotide
tgctgggattacaggcgtgagccatcgtctacttctaattttttaaaggaaccaccacactgttttccacagtggctgcatcattttacattttgtatctggtttcttttgcttaatattggtcagggagattcatcaatgtgtacagcacaagtttgtttctttataattgctgtgttaaggattccattgtatgaacaaaacacaatctattaattcccctattgatggacatttggattgttgcccactgtggctattatgaataatgctgtcattaaccgtcttgtacacattttctggtggtcataggcacctgtttctcctgtgggtatatttgggaatggaattgctgggtcatagggtaggcaattg

SEQ ID NO: 5028 - DNA, 28 bp, Artificial Sequence
  Synthetic oligonucleotide
ccgccggccctgagcgggacccgcgtcc

SEQ ID NO: 5029 - DNA, 36 bp, Artificial Sequence
  Synthetic oligonucleotide
tggccagcaagaccgcgaggaggatcttccaggagc

SEQ ID NO: 5030 - DNA, 11 bp, Artificial Sequence
  Synthetic oligonucleotide
ccacggagccg

SEQ ID NO: 5031 - DNA, 19 bp, Artificial Sequence
  Synthetic oligonucleotide
aaaactaaagcagctgccc

SEQ ID NO: 5032 - DNA, 30 bp, Artificial Sequence
  Synthetic oligonucleotide
ccggcgtggaggatgagccgctgctgagag

SEQ ID NO: 5033 - DNA, 5 bp, Artificial Sequence
  Synthetic oligonucleotide
aaaac

SEQ ID NO: 5034 - DNA, 22 bp, Artificial Sequence
  Synthetic oligonucleotide
ccccgccgctttgtcatcttcc

SEQ ID NO: 5035 - DNA, 68 bp, Artificial Sequence
  Synthetic oligonucleotide
ccatcgagtaccatgatatctggcagatgtataagaaggcagaggcttccttttggaccgccgaggag

SEQ ID NO: 5036 - DNA, 117 bp, Artificial Sequence
  Synthetic oligonucleotide
gtggacctctccaaggacattcagcactgggaatccctgaaacccgaggagagatattttatatcccatgttctggctttctttgcagcaagcgatggcatagtaaatgaaaacttg

SEQ ID NO: 5037 - DNA, 53 bp, Artificial Sequence
  Synthetic oligonucleotide
gtggagcgatttagccaagaagttcagattacagaagcccgctgtttctatgg

SEQ ID NO: 5038 - DNA, 26 bp, Artificial Sequence
  Synthetic oligonucleotide
cttccaaattgccatggaaaacatac

SEQ ID NO: 5039 - DNA, 55 bp, Artificial Sequence
  Synthetic oligonucleotide
attctgaaatgtatagtcttcttattgacacttacataaaagatcccaaagaaag

SEQ ID NO: 5040 - DNA, 95 bp, Artificial Sequence
  Synthetic oligonucleotide
ggaatttctcttcaatgccattgaaacgatgccttgtgtcaagaagaaggcagactgggccttgcgctggattggggacaaagaggctacctatg

SEQ ID NO: 5041 - DNA, 105 bp, Artificial Sequence
  Synthetic oligonucleotide
ggtttacactgtgattttgcttgcctgatgttcaaacacctggtacacaaaccatcggaggagagagtaagagaaataattatcaatgctgttcggatagaacag

SEQ ID NO: 5042 - DNA, 114 bp, Artificial Sequence
  Synthetic oligonucleotide
gagttcctcactgaggccttgcctgtgaagctcattgggatgaattgcactctaatgaagcaatacattgagtttgtggcagacagacttatgctggaactgggttttagcaag

SEQ ID NO: 5043 - DNA, 101 bp, Artificial Sequence
  Synthetic oligonucleotide
gtgctgggagaccgtgaagtgcaaagcagatggagtccaggccctcggggagacagcacgccagtgagggagatggagaccaatcacccacccagtgtgcg

SEQ ID NO: 5044 - DNA, 232 bp, Artificial Sequence
  Synthetic oligonucleotide
gctaaatgtcatgtatttttcatggcccctccaggtattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatg

SEQ ID NO: 5045 - DNA, 447 bp, Artificial Sequence
  Synthetic oligonucleotide
gtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccag

SEQ ID NO: 5046 - DNA, 249 bp, Artificial Sequence
  Synthetic oligonucleotide
catataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagag

SEQ ID NO: 5047 - DNA, 168 bp, Artificial Sequence
  Synthetic oligonucleotide
tgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggg

SEQ ID NO: 5048 - DNA, 673 bp, Artificial Sequence
  Synthetic oligonucleotide
gacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagagttg

SEQ ID NO: 5049 - DNA, 69 bp, Artificial Sequence
  Synthetic oligonucleotide
acaatggccccagggtccttatctctagcagatgttttgaaaaagtcatctgttttgctttttttccag

SEQ ID NO: 5050 - DNA, 108 bp, Artificial Sequence
  Synthetic oligonucleotide
aagtagtaagtctgctggcctccgccatcttagtaaagtaacagtcccatgaaacaaagatgcagtcgggcactcactggagagttctgggcctctgcctcttatcag

SEQ ID NO: 5051 - DNA, 22 bp, Artificial Sequence
  Synthetic oligonucleotide
ttggcgtttgggggcaagatgg

SEQ ID NO: 5052 - DNA, 15 bp, Artificial Sequence
  Synthetic oligonucleotide
gtaatgaagaaatgg

SEQ ID NO: 5053 - DNA, 18 bp, Artificial Sequence
  Synthetic oligonucleotide
gtggtattacacagacac

SEQ ID NO: 5054 - DNA, 47 bp, Artificial Sequence
  Synthetic oligonucleotide
gacaaaacaaggagaggccaccacctgttcccaacccagactatgag

SEQ ID NO: 5055 - DNA, 21 bp, Artificial Sequence
  Synthetic oligonucleotide
cccatccggaaaggccagcgg

SEQ ID NO: 5056 - DNA, 376 bp, Artificial Sequence
  Synthetic oligonucleotide
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcag

SEQ ID NO: 5057 - DNA, 239 bp, Artificial Sequence
  Synthetic oligonucleotide
ggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaag

SEQ ID NO: 5058 - DNA, 246 bp, Artificial Sequence
  Synthetic oligonucleotide
gtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggag

SEQ ID NO: 5059 - DNA, 159 bp, Artificial Sequence
  Synthetic oligonucleotide
gtaagccagagagcgtgtgcattgcccgggtgctgtgcaggcctgcctcaccccgagtcctggccccccatggggaactccttccctgcaacagcctcccaactccctactttctgtctcttccatttttggctaattgacaactctttctcccactct

SEQ ID NO: 5060 - DNA, 288 bp, Artificial Sequence
  Synthetic oligonucleotide
gtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatgga

SEQ ID NO: 5061 - DNA, 275 bp, Artificial Sequence
  Synthetic oligonucleotide
gtctcacgctgtcacccaggctggagtgcagtggtgcaatggtacttcctttatttattcaagatttatttattggccgggtgtggtggctcatgcctgtaatcccagcactttgggaggccaaggcggggtcgatcacctaaggtcaggagtttcagactagcctggccaacatgatgaaaccccgtctctactaaaaaatacaaaaattagccaggtgcagtggctcacacttgtaatcctggcactttgggaggccaaggcaggcggatcac

SEQ ID NO: 5062 - DNA, 193 bp, Artificial Sequence
  Synthetic oligonucleotide
ctgaggtcaggagtttgagaccagcctggccaacatggtgaaaccccatctctacaaaaaatacaaaaaaaattagctgggcgtggtggcgtaggcctgtcatctcagctactcagaaggctgaggcaggagaatcgcttgaacccaagaagtggaggttgtagtgagccgagattgtgccactgctctccag

SEQ ID NO: 5063 - DNA, 143 bp, Artificial Sequence
  Synthetic oligonucleotide
cctgggtgacagagcgagactccatcccccaccgccccgcaaaaaaaaaggaaaagagaaagatttattttttgaacctctggtttgtgccaggtaccatattaggccctaaagataccagagggaacaaaacagacctcatg

SEQ ID NO: 5064 - DNA, 523 bp, Artificial Sequence
  Synthetic oligonucleotide
gttatgagaagaataaagactggaaggaaaatgggagaatgttggggagggttagtttgggataaggaaggtgaggacagggcaggccccaactgacaaggaaacgtttgaataaagagcctaaggaggcaaggcggggagccgcatgggtgtctgggggtaagagtattcaaggcagagggcacggctgggattgatgccctgagatgggagtggttttccatattctaggagcactgagagaccaatgtggctgtagtgagatcaatcggagggacatagggaagagaggaatcctaaggggtcaggtcagagacggcttccagggtttggagtgtgatggggcaccattgtaagattccaggcgggaagttttcctctggatactccatacctttgaaagaccccagcctcaagttctaagcatgtggtgggaggctcccacctggtgcaatccccgcctcagctcctgagaaactcctcatgtggcatttcctgcttgcctcccacttgggccccacag

SEQ ID NO: 5065 - DNA, 220 bp, Artificial Sequence
  Synthetic oligonucleotide
tggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtc

SEQ ID NO: 5066 - DNA, 131 bp, Artificial Sequence
  Synthetic oligonucleotide
gagtcctgatcaggcctcacccctcccctgggactttcccacccaggaaaggaggaccagtcaggatgaggccccgccttttcccccaccctcccatgagactgccctgcccaggtatcctgggggaagag

SEQ ID NO: 5067 - DNA, 185 bp, Artificial Sequence
  Synthetic oligonucleotide
gtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcag

SEQ ID NO: 5068 - DNA, 404 bp, Artificial Sequence
  Synthetic oligonucleotide
ctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtc

SEQ ID NO: 5069 - DNA, 172 bp, Artificial Sequence
  Synthetic oligonucleotide
gctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccag

SEQ ID NO: 5070 - DNA, 209 bp, Artificial Sequence
  Synthetic oligonucleotide
ttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaaaaaact

SEQ ID NO: 5071 - DNA, 114 bp, Artificial Sequence
  Synthetic oligonucleotide
cctgaactctttgcttccggaatccgggattgttgctgacatagaattagaaaacgtccttgatcctgacagcttctacgagctcaaaagccaacccttaccccttcgctcaag

SEQ ID NO: 5072 - DNA, 19 bp, Artificial Sequence
  Synthetic oligonucleotide
cctcccaatatcactgcag

SEQ ID NO: 5073 - DNA, 19 bp, Artificial Sequence
  Synthetic oligonucleotide
gccacaccagccaccccag

SEQ ID NO: 5074 - DNA, 27 bp, Artificial Sequence
  Synthetic oligonucleotide
ctacactctctgcatcgtcttctgcag

SEQ ID NO: 5075 - DNA, 105 bp, Artificial Sequence
  Synthetic oligonucleotide
attgatgatgtcattgatgagatcatcagcctggagtccagttacaatgatgaaatgctcagctatctgcccggaggcaccacaggactgcagctccccagcacg

SEQ ID NO: 5076 - DNA, 118 bp, Artificial Sequence
  Synthetic oligonucleotide
ctgcctgtgtcagggaatctgcttgatgtgtacagtagtcaaggcgtggccacaccagccatcactgtcagcaactcctgcccagctgagctgcccaacatcaaacgggagatctctg

SEQ ID NO: 5077 - DNA, 57 bp, Artificial Sequence
  Synthetic oligonucleotide
agaccgaggcaaaggcccttttgaaggaacggcagaagaaagacaatcacaacctaa

SEQ ID NO: 5078 - DNA, 26 bp, Artificial Sequence
  Synthetic oligonucleotide
ttcttcctctcctcccctctccaaag

SEQ ID NO: 5079 - DNA, 34 bp, Artificial Sequence
  Synthetic oligonucleotide
ttgagcgtcgcaggcgattcaacattaacgacag

SEQ ID NO: 5080 - DNA, 42 bp, Artificial Sequence
  Synthetic oligonucleotide
gatcaaggaactgggcactctcatccctaagtccagtgaccc

SEQ ID NO: 5081 - DNA, 64 bp, Artificial Sequence
  Synthetic oligonucleotide
ggagatgcgctggaacaagggcaccatcctgaaggcctctgtggattatatccgcaagctgcag

SEQ ID NO: 5082 - DNA, 84 bp, Artificial Sequence
  Synthetic oligonucleotide
aaggagcagcagcgctccaaagacctggagagccggcagcgatccctggagcaggccaaccgcagcctgcagctccgaattcag

SEQ ID NO: 5083 - DNA, 106 bp, Artificial Sequence
  Synthetic oligonucleotide
gaactagaactgcaggcccagatccatggcctgccagtacctcccactccagggctgctttccttggccacgacttcggcttctgacagcctcaagccagagcagc

SEQ ID NO: 5084 - DNA, 109 bp, Artificial Sequence
  Synthetic oligonucleotide
ggggggtgccctgtccccactgcgggctgcctccgatcccctgctctcttcagtgtcccctgctgtctccaaggccagcagccgccgcagcagcttcagcatggaagag

SEQ ID NO: 5085 - DNA, 91 bp, Artificial Sequence
  Synthetic oligonucleotide
gagatgtgatcaggccccacccctgtaatcaggcaaggaggaggagtcagatgaggccctgcaccttccccaaaggaaccgcccagtgcag

SEQ ID NO: 5086 - DNA, 84 bp, Artificial Sequence
  Synthetic oligonucleotide
gatgttgctccatcctttgtcttggaaccaccagtctagtccgtcctggcacagaagaggagtcaagtaatggaggtcccagcc

SEQ ID NO: 5087 - DNA, 40 bp, Artificial Sequence
  Synthetic oligonucleotide
ctgggggtttaagctctgccccttccccatgaaccctgcc

SEQ ID NO: 5088 - DNA, 5 bp, Artificial Sequence
  Synthetic oligonucleotide
ctgct

SEQ ID NO: 5089 - DNA, 39 bp, Artificial Sequence
  Synthetic oligonucleotide
ctgccttcttccttgaggggcagtttgggaaggtgatgg

SEQ ID NO: 5090 - DNA, 66 bp, Artificial Sequence
  Synthetic oligonucleotide
gtattagtgggggactgagttcaggttaccagaaccagtacctcagtattctttttcaacatgtag

SEQ ID NO: 5091 - DNA, 21 bp, Artificial Sequence
  Synthetic oligonucleotide
ggcaagaggatgaaggaaggg

SEQ ID NO: 5092 - DNA, 159 bp, Artificial Sequence
  Synthetic oligonucleotide
agtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctg

SEQ ID NO: 5093 - DNA, 127 bp, Artificial Sequence
  Synthetic oligonucleotide
ccggtggcagcaggttccgggatacccgaggtcaaatgctatctgaatggcgtaaaggtgccaggaatcgtccgtctccggaccctgctctgcaaggtccttggagtgctgttcagtgtggctggag

SEQ ID NO: 5094 - DNA, 130 bp, Artificial Sequence
  Synthetic oligonucleotide
ctatggatttgggtttcttcgtcgtgatgggggtcattgggggcctcctgggagccacattcaactgtctgaacaagaggcttgcaaagtaccgtatgcgaaacgtgcacccgaaacctaagctcgtcag

SEQ ID NO: 5095 - DNA, 124 bp, Artificial Sequence
  Synthetic oligonucleotide
gtcacagaagatgtgaattcaagtatcaagacatttttttgtcccaatgatacctacaatgacatggccacactcttcttcaacccgcaggagtctgccatcctccagctcttccaccaggatg

SEQ ID NO: 5096 - DNA, 154 bp, Artificial Sequence
  Synthetic oligonucleotide
gtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaag

SEQ ID NO: 5097 - DNA, 160 bp, Artificial Sequence
  Synthetic oligonucleotide
ctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatg

SEQ ID NO: 5098 - DNA, 187 bp, Artificial Sequence
  Synthetic oligonucleotide
gctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaag

SEQ ID NO: 5099 - DNA, 158 bp, Artificial Sequence
  Synthetic oligonucleotide
aaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggag

SEQ ID NO: 5100 - DNA, 123 bp, Artificial Sequence
  Synthetic oligonucleotide
tccccaagtgaagactggaccatggaggagcggttccgccctctgaccttccacggcctgatccttcggtcgcagcttgtcaccctgcttgtccgaggagtttgttactctgaaagccagtcg

SEQ ID NO: 5101 - DNA, 126 bp, Artificial Sequence
  Synthetic oligonucleotide
gatgtcaccccatacatgaacccttcgcctttcaccgtctcgcccaacacccacgtctcccaagtcttcaacctgttcagaacgatgggcctgcgccacctgcccgtggtgaacgctgtgggagag

SEQ ID NO: 5102 - DNA, 391 bp, Artificial Sequence
  Synthetic oligonucleotide
gtgagcgaggccccggccctgcccccacctttgagagaggatcccctagccaggtgctgtttgtgcacccaggcttctcaccagaaacgtaggcatcccaccaggaggggagagtgtggcccaacactagcgttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtagggatttgcgcattagatgagagaatttcaagcaaaatactttgagttttacaaagatataaaacacctagtaattat

SEQ ID NO: 5103 - DNA, 262 bp, Artificial Sequence
  Synthetic oligonucleotide
agcccagcccaccctctcctggtgctgcctggggaggcaaatcatgctcactccggcgggcacagctggctggggctgttccggggcatggaagattcccagtcacccactcactcagaaagccgggagtcatcggacaccttgctggtcagaggtcctgggggtggttttgaaccatcagagcttggacttttctgacttccccagcaaggatcttcccacttcctgctccctgtgttcccaccctccagtgttggcacag

SEQ ID NO: 5104 - DNA, 721 bp, Artificial Sequence
  Synthetic oligonucleotide
gcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaag

SEQ ID NO: 5105 - DNA, 1410 bp, Artificial Sequence
  Synthetic oligonucleotide
gtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtg

SEQ ID NO: 5106 - DNA, 306 bp, Artificial Sequence
  Synthetic oligonucleotide
aggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttct

SEQ ID NO: 5107 - DNA, 220 bp, Artificial Sequence
  Synthetic oligonucleotide
gagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacag

SEQ ID NO: 5108 - DNA, 122 bp, Artificial Sequence
  Synthetic oligonucleotide
ctttagaaaaggaaaatacagggaaagggataaacctcactgacttggaggaaatcaagaggagtgagcacagcatcagaaagccccctggccccagactgcacccgctttcctggccctac

SEQ ID NO: 5109 - DNA, 555 bp, Artificial Sequence
  Synthetic oligonucleotide
gtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctcaccgccgtgcctcaggattctttctcctcgacgctggtacccgtgcggggaaa

SEQ ID NO: 5110 - DNA, 60 bp, Artificial Sequence
  Synthetic oligonucleotide
accatccttggagaaacacaggaggaggaggatgagattcttccaaggaaagactatgag

SEQ ID NO: 5111 - DNA, 66 bp, Artificial Sequence
  Synthetic oligonucleotide
agtttggattatgatcgctgtatcaatgacccttacctggaagttttggagaccatggataataag

SEQ ID NO: 5112 - DNA, 4 bp, Artificial Sequence
  Synthetic oligonucleotide
aaag

SEQ ID NO: 5113 - DNA, 62 bp, Artificial Sequence
  Synthetic oligonucleotide
gtcgaagatatgaggcggtgaagtggatggtggtgtttgccattggagtctgcactggcctg

SEQ ID NO: 5114 - DNA, 63 bp, Artificial Sequence
  Synthetic oligonucleotide
gtgggtctctttgtggacttttttgtgcgactcttcacccaactcaagttcggagtggtacag

SEQ ID NO: 5115 - DNA, 4 bp, Artificial Sequence
  Synthetic oligonucleotide
acat

SEQ ID NO: 5116 - DNA, 70 bp, Artificial Sequence
  Synthetic oligonucleotide
cggtggaggagtgcagccagaaaggctgcctcgctctgtctctccttgaactcctgggttttaacctcac

SEQ ID NO: 5117 - DNA, 37 bp, Artificial Sequence
  Synthetic oligonucleotide
ctttgtcttcctggcaagcctccttgttctcattgag

SEQ ID NO: 5118 - DNA, 68 bp, Artificial Sequence
  Synthetic oligonucleotide
ggctcttcgtggggaaggaaggccccatgatccacagtggttcggtggtgggagctggcctccctcag

SEQ ID NO: 5119 - DNA, 59 bp, Artificial Sequence
  Synthetic oligonucleotide
tttcagagcatctccttacggaagatccagtttaacttcccctatttccgaagcgacag

SEQ ID NO: 5120 - DNA, 26 bp, Artificial Sequence
  Synthetic oligonucleotide
agacaagagagactttgtatcagcag

SEQ ID NO: 5121 - DNA, 107 bp, Artificial Sequence
  Synthetic oligonucleotide
gagcggctgctggagttgctgcagctttcggggcgccaatcgggggtaccttgttcagtctagaggagggttcgtccttctggaaccaagggctcacgtggaaagtg

SEQ ID NO: 5122 - DNA, 114 bp, Artificial Sequence
  Synthetic oligonucleotide
ctcttttgttccatgtctgccaccttcaccctcaacttcttccgttctgggattcagtttggaagctggggttccttccagctccctggattgctgaactttggcgagtttaag

SEQ ID NO: 5123 - DNA, 37 bp, Artificial Sequence
  Synthetic oligonucleotide
tgctctgactctgataaaaaatgtcatctctggacag

SEQ ID NO: 5124 - DNA, 104 bp, Artificial Sequence
  Synthetic oligonucleotide
agtcttagagagcctccttgtgtctctggtaaccaccgtggtggtgtttgtggcctcgatggtgttaggagaatgccgacagatgtcctcttcgagtcaaatcg

SEQ ID NO: 5125 - DNA, 23 bp, Artificial Sequence
  Synthetic oligonucleotide
gtaatgactcattccagctccag

SEQ ID NO: 5126 - DNA, 107 bp, Artificial Sequence
  Synthetic oligonucleotide
gtggccaaatggacaggggactttttcaataagggcatttatgatatccacgtgggcctgcgaggcgtgccgcttctggaatgggagacagaggtggaaatggacaa

SEQ ID NO: 5127 - DNA, 34 bp, Artificial Sequence
  Synthetic oligonucleotide
atacactccctaccccaacctataccctgaccag

SEQ ID NO: 5128 - DNA, 108 bp, Artificial Sequence
  Synthetic oligonucleotide
agcgccagccagccgcgcctctcctatgccgagatggccgaggactacccgcggtaccccgacatccacgacctggacctgacgctgctcaacccgcgcatgatcgtg

SEQ ID NO: 5129 - DNA, 32 bp, Artificial Sequence
  Synthetic oligonucleotide
atcgtggggatcatcacacggcacaacctcac

SEQ ID NO: 5130 - DNA, 45 bp, Artificial Sequence
  Synthetic oligonucleotide
ctatgaatttctgcaggcccggctgaggcagcactaccagaccat

SEQ ID NO: 5131 - DNA, 5 bp, Artificial Sequence
  Synthetic oligonucleotide
ctgac

SEQ ID NO: 5132 - DNA, 30 bp, Artificial Sequence
  Synthetic oligonucleotide
atgaacactcttcctgatcctctcctctag

SEQ ID NO: 5133 - DNA, 34 bp, Artificial Sequence
  Synthetic oligonucleotide
aattcatctcctcctgctagcagccgcgtcctgg

SEQ ID NO: 5134 - DNA, 6 bp, Artificial Sequence
  Synthetic oligonucleotide
caaatt

SEQ ID NO: 5135 - DNA, 15 bp, Artificial Sequence
  Synthetic oligonucleotide
cttgaaatccatcag

SEQ ID NO: 5136 - DNA, 178 bp, Artificial Sequence
  Synthetic oligonucleotide
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacag

SEQ ID NO: 5137 - DNA, 278 bp, Artificial Sequence
  Synthetic oligonucleotide
cctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccag

SEQ ID NO: 5138 - DNA, 255 bp, Artificial Sequence
  Synthetic oligonucleotide
atggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatg

SEQ ID NO: 5139 - DNA, 190 bp, Artificial Sequence
  Synthetic oligonucleotide
ctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctg

SEQ ID NO: 5140 - DNA, 280 bp, Artificial Sequence
  Synthetic oligonucleotide
cggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagctgtcaaaaggaacgatgcaggatcctatgaatgtgaaatacagaacccagcgagtgccaaccgcagtgacccagtcaccctgaatgtcctct

SEQ ID NO: 5141 - DNA, 82 bp, Artificial Sequence
  Synthetic oligonucleotide
aatgacacaggattctacaccctacacgtcataaagtcagatcttgtgaatgaagaagcaactggccagttccgggtatacc

SEQ ID NO: 5142 - DNA, 104 bp, Artificial Sequence
  Synthetic oligonucleotide
cggagctgcccaagccctccatctccagcaacaactccaaacccgtggaggacaaggatgctgtggccttcacctgtgaacctgagactcaggacgcaacctac

SEQ ID NO: 5143 - DNA, 48 bp, Artificial Sequence
  Synthetic oligonucleotide
ctgtggtgggtaaacaatcagagcctcccggtcagtcccaggctgcag

SEQ ID NO: 5144 - DNA, 48 bp, Artificial Sequence
  Synthetic oligonucleotide
ctgtccaatggcaacaggaccctcactctattcaatgtcacaagaaat

SEQ ID NO: 5145 - DNA, 79 bp, Artificial Sequence
  Synthetic oligonucleotide
gacacagcaagctacaaatgtgaaacccagaacccagtgagtgccaggcgcagtgattcagtcatcctgaatgtcctct

SEQ ID NO: 5146 - DNA, 3 bp, Artificial Sequence
  Synthetic oligonucleotide
cag

SEQ ID NO: 5147 - DNA, 6 bp, Artificial Sequence
  Synthetic oligonucleotide
agccac

SEQ ID NO: 5148 - DNA, 7 bp, Artificial Sequence
  Synthetic oligonucleotide
ccaaacc

SEQ ID NO: 5149 - DNA, 18 bp, Artificial Sequence
  Synthetic oligonucleotide
cttcatcaccagcaacaa

SEQ ID NO: 5150 - DNA, 70 bp, Artificial Sequence
  Synthetic oligonucleotide
ctccaaccccgtggaggatgaggatgctgtagccttaacctgtgaacctgagattcagaacacaacctac

SEQ ID NO: 5151 - DNA, 24 bp, Artificial Sequence
  Synthetic oligonucleotide
ctgtggtgggtaaataatcagagc

SEQ ID NO: 5152 - DNA, 24 bp, Artificial Sequence
  Synthetic oligonucleotide
ctcccggtcagtcccaggctgcag

SEQ ID NO: 5153 - DNA, 78 bp, Artificial Sequence
  Synthetic oligonucleotide
ctgtccaatgacaacaggaccctcactctactcagtgtcacaaggaatgatgtaggaccctatgagtgtggaatccag

SEQ ID NO: 5154 - DNA, 30 bp, Artificial Sequence
  Synthetic oligonucleotide
aacgaattaagtgttgaccacagcgaccca

SEQ ID NO: 5155 - DNA, 19 bp, Artificial Sequence
  Synthetic oligonucleotide
gtcatcctgaatgtcctct

SEQ ID NO: 5156 - DNA, 19 bp, Artificial Sequence
  Synthetic oligonucleotide
atggcccagacgaccccac

SEQ ID NO: 5157 - DNA, 18 bp, Artificial Sequence
  Synthetic oligonucleotide
catttccccctcatacac

SEQ ID NO: 5158 - DNA, 28 bp, Artificial Sequence
  Synthetic oligonucleotide
ctattaccgtccaggggtgaacctcagc

SEQ ID NO: 5159 - DNA, 127 bp, Artificial Sequence
  Synthetic oligonucleotide
gactttgctccagcagcctgtcccagtgaggacagggacacagtactcggccacaccatggggcgcccactgcacctcgtcctgctcagtgcctccctggctggcctcctgctgctcggggaaagtc

SEQ ID NO: 5160 - DNA, 359 bp, Artificial Sequence
  Synthetic oligonucleotide
cacagaacagtgggctgaaagcaccctagggagggagaattcaaggaagggggcttgggtggccaggctgagccagcgtgagcatgtgaggaggctggtgagctgattgggtgggatgtgtctacttctccagagaagggtgcatgggtctagagcaggtgcctcatgctgtacctcatagagaactggggggaggggggaaatgggcatttccctccacagcccccaaagtgcctgaggaaagtgttgataaagaagccaaactctgtaaaatatttgacagagatttattctgagccaaatgtgaggaccacgacccatgacacagccttggaaggtcctgagaacatgtgtccaag

SEQ ID NO: 5161 - DNA, 161 bp, Artificial Sequence
  Synthetic oligonucleotide
tgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacg

SEQ ID NO: 5162 - DNA, 2202 bp, Artificial Sequence
  Synthetic oligonucleotide
cccgcgtcctgccttggcctccgtggctcgagctgagagccacagcctagagcgccagcgcgcaggcgcacaactgacgccaggccacgaacccagtactgcgcctgcacagcagaagcactagcactgaggccgggccgcgaacccggcactgcgcctgcgcagcaaaaggacacgcactgaggccaggccgcgaacccagcacggtgcctgcgcagcaggaagaccggcatccacaccggacgacgaacccagcatcgcgcctgcgcagtaggaggagagcgatgccaccaggccgcgattgcgcagccgcagcagccccgcgcggaagacgctgccctcctctcccccgaagaggcggggcttcgaacgaacctggaaatggccgaggggtctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcagtgagcaacagctaggccagccgcggctggtgccatcagccacaccactaactgtggacccaaatggaaactttgaggccccttacaggtcccccagcgcaggccaccgccgaaggttactggggaagacccctgcagcttccatgtggacattactcgcttgcttcatcccggagtgcagtcacctgcagcctgggaccacctgactgatgtcaccctggagatccatgccaaaagagctggggaaagttcaccttctaatgacccctgcggaccagggtgaagttacaagttatggccaggtcaaggaattataagtcaataaataaactgcctcagggagacgtactcagagtccaggaaaatctaggaaacaccaagaagggcgagcgcagcatcagcccctgcaaaattgcactgctgcctcctggctcacatgttgccccatccttactttagcctcaaaggcaaggagacccaatattatttgagtacttggatttgatcctgagtgactttctgagaaagcagtgtatcatctgccctaagatcaccacatatatgacaaggtttttggatgagttgagatttctagacattgaaaccctcatgatgaacgtcatcccgggtagcaggggctaagcctttcatcacctgctacaacaagctggacattaacttgtatttgagaattgctccaggactctaccttcagatgctggttagtagcattgactggatttatgaaattggatgccagttaaggaataagagaatgtatttgatttgccaccctatatggtctgtgcagactgtcatgatctcattgaaatccaagaaaagattatgtcagggatgaagcacatcacaggtggttacaaggtcacccaccatccagatggctcagaaagccaaacctatgggttgacttctcctcacccttctggagaatcagtgtggtagaagagcttgaaaaagtgctgggtgtgacgctgccagaaactaacctctttggaactgaagaaactcaaaaaattattggtgatatctatgtaacaaaagcttttgaaagtcttctacctcagaacatattcaggcgccttgataaacttgtcaaggagttcctgaaagtgacttacatcagtcccacatttatctgttatcacctgcagataatgagctctttgaccaaatgatctctctaagagggtctcactgagcactttgagctatttgtcatgaagatagctgaatgtttccatgcagcaacagcagcagctgttgacaaacaagacaaggccagcaaagatgatgaggccacattcatagatgaaagcttccatgcaaccctggaatatgggcttccgcccacagctggttggagcgtgacaatcaaatgtgttaccatgtttctcacagactcccacaacatcaaggaaatatttctgactcctggcatgaaacttgaagaaagagaatgtagcagccactaatacaatggaaagcgcaacattgacacgtctatctagaaaattttaattgtctaagttgtgtgactcagatatctttgcatttctgcaaaagatcaaggtctactctaattcttaattaaattaagaattcctttttattacttgttagcaaataaatggcttgtctctaacaga

SEQ ID NO: 5163 - DNA, 989 bp, Artificial Sequence
  Synthetic oligonucleotide
ttttttccactggtagaatttttctttagtaaaagtaaataatgctgatccaagtttatgtttcactcagcatcgtttctcaaacactcttctttacttatatatagctaccctatagctaagctatattttattgtatgatgcatttactcttttcagagtttggccatataagttatttctaaatattgctattaggaaaacacatatgcatgcatttcttctagattatcatctaagagtggcttctccagagagagacgactgaattaaaggttatcaacaagttccaattccagataagatgaagaaatcacattccacactgcctctcccactgagtgtagctccaaaacatggatagaatgcatgtagcagctatttgaggaccctaaaaagtaaatcgcagtgtattgcagaataagactacaattagatgtatgatatgatacaactggctgtgagtttatcattttttcctccagtcttccagacatcacttgacctgaatctaatggacatttataggattctccaccatagccaagtacactttccttccacatatggaaaattcctcaaggtagactatatcctgtgtcttaaagcatacctcaataaaaagattgaactcacataaagtatgttttctgaccataatggaattaaagtaaaaattactaacagaaaaataactggaaacttccctaagtactcggaaattaagtcacacatgtataaataatctgtgagtcaaagagaaaattttaaggggagtaagaaagtattttgagctgaacaaaaatgaatatgtaacataaaatctgtgggatgcagctaaaaaagcagtgtttcaagggaaatttatagcattaaatgctcacatgggaaaagaaagacggtctcaaattgtttatgtaagcttccactttaataaactagaaaaaaagaaaaaaataaaccaaaaggaaattgaaaaagcagaaatc

SEQ ID NO: 5164 - DNA, 25 bp, Artificial Sequence
  Synthetic oligonucleotide
aatgaattctggaataaatacaaag

SEQ ID NO: 5165 - DNA, 45 bp, Artificial Sequence
  Synthetic oligonucleotide
atggcgaccagtgtgagaccagtccttgccagaaccagggcaaat

SEQ ID NO: 5166 - DNA, 69 bp, Artificial Sequence
  Synthetic oligonucleotide
gtaaagacggcctcggggaatacacctgcacctgtttagaaggattcgaaggcaaaaactgtgaattat

SEQ ID NO: 5167 - DNA, 105 bp, Artificial Sequence
  Synthetic oligonucleotide
tcacacggaagctctgcagcctggacaacggggactgtgaccagttctgccacgaggaacagaactctgtggtgtgctcctgcgcccgcgggtacaccctggctg

SEQ ID NO: 5168 - DNA, 27 bp, Artificial Sequence
  Synthetic oligonucleotide
acaacggcaaggcctgcattcccacag

SEQ ID NO: 5169 - DNA, 73 bp, Artificial Sequence
  Synthetic oligonucleotide
ggccctacccctgtgggaaacagaccctggaacgcaggaagaggtcagtggcccaggccaccagcagcagcgg

SEQ ID NO: 5170 - DNA, 8 bp, Artificial Sequence
  Synthetic oligonucleotide
ggaggccc

SEQ ID NO: 5171 - DNA, 7 bp, Artificial Sequence
  Synthetic oligonucleotide
ctgacag

SEQ ID NO: 5172 - DNA, 6 bp, Artificial Sequence
  Synthetic oligonucleotide
catcac

SEQ ID NO: 5173 - DNA, 30 bp, Artificial Sequence
  Synthetic oligonucleotide
atggaagccatatgatgcagccgacctgga

SEQ ID NO: 5174 - DNA, 22 bp, Artificial Sequence
  Synthetic oligonucleotide
ccccaccgagaaccccttcgac

SEQ ID NO: 5175 - DNA, 50 bp, Artificial Sequence
  Synthetic oligonucleotide
ctgcttgacttcaaccagacgcagcctgagaggggcgacaacaacctcac

SEQ ID NO: 5176 - DNA, 49 bp, Artificial Sequence
  Synthetic oligonucleotide
caggatcgtgggaggccaggaatgcaaggacggggagtgtccctggcag

SEQ ID NO: 5177 - DNA, 18 bp, Artificial Sequence
  Synthetic oligonucleotide
gccctgctcatcaatgag

SEQ ID NO: 5178 - DNA, 6 bp, Artificial Sequence
  Synthetic oligonucleotide
gaaaac

SEQ ID NO: 5179 - DNA, 24 bp, Artificial Sequence
  Synthetic oligonucleotide
gagggtttctgtggtggaactatt

SEQ ID NO: 5180 - DNA, 4 bp, Artificial Sequence
  Synthetic oligonucleotide
ctga

SEQ ID NO: 5181 - DNA, 14 bp, Artificial Sequence
  Synthetic oligonucleotide
gcgagttctacatc

SEQ ID NO: 5182 - DNA, 20 bp, Artificial Sequence
  Synthetic oligonucleotide
ctaacggcagcccactgtct

SEQ ID NO: 5183 - DNA, 8 bp, Artificial Sequence
  Synthetic oligonucleotide
ctaccaag

SEQ ID NO: 5184 - DNA, 14 bp, Artificial Sequence
  Synthetic oligonucleotide
ccaagagattcaag

SEQ ID NO: 5185 - DNA, 6 bp, Artificial Sequence
  Synthetic oligonucleotide
gtgagg

SEQ ID NO: 5186 - DNA, 4 bp, Artificial Sequence
  Synthetic oligonucleotide
gtag

SEQ ID NO: 5187 - DNA, 17 bp, Artificial Sequence
  Synthetic oligonucleotide
gggaccggaacacggag

SEQ ID NO: 5188 - DNA, 27 bp, Artificial Sequence
  Synthetic oligonucleotide
caggaggagggcggtgaggcggtgcac

SEQ ID NO: 5189 - DNA, 9 bp, Artificial Sequence
  Synthetic oligonucleotide
gaggtggag

SEQ ID NO: 5190 - DNA, 20 bp, Artificial Sequence
  Synthetic oligonucleotide
gtggtcatcaagcacaaccg

SEQ ID NO: 5191 - DNA, 15 bp, Artificial Sequence
  Synthetic oligonucleotide
gttcacaaaggagac

SEQ ID NO: 5192 - DNA, 16 bp, Artificial Sequence
  Synthetic oligonucleotide
ctatgacttcgacatc

SEQ ID NO: 5193 - DNA, 12 bp, Artificial Sequence
  Synthetic oligonucleotide
gccgtgctccgg

SEQ ID NO: 5194 - DNA, 8 bp, Artificial Sequence
  Synthetic oligonucleotide
ctcaagac

SEQ ID NO: 5195 - DNA, 9 bp, Artificial Sequence
  Synthetic oligonucleotide
ccccatcac

SEQ ID NO: 5196 - DNA, 43 bp, Artificial Sequence
  Synthetic oligonucleotide
cttccgcatgaacgtggcgcctgcctgcctccccgagcgtgac

SEQ ID NO: 5197 - DNA, 27 bp, Artificial Sequence
  Synthetic oligonucleotide
tgggccgagtccacgctgatgacgcag

SEQ ID NO: 5198 - DNA, 16 bp, Artificial Sequence
  Synthetic oligonucleotide
aagacggggattgtga

SEQ ID NO: 5199 - DNA, 20 bp, Artificial Sequence
  Synthetic oligonucleotide
gcggcttcgggcgcacccac

SEQ ID NO: 5200 - DNA, 20 bp, Artificial Sequence
  Synthetic oligonucleotide
gagaagggccggcagtccac

SEQ ID NO: 5201 - DNA, 72 bp, Artificial Sequence
  Synthetic oligonucleotide
caggctcaagatgctggaggtgccctacgtggaccgcaacagctgcaagctgtccagcagcttcatcatcac

SEQ ID NO: 5202 - DNA, 9 bp, Artificial Sequence
  Synthetic oligonucleotide
ccagaacat

SEQ ID NO: 5203 - DNA, 12 bp, Artificial Sequence
  Synthetic oligonucleotide
gttctgtgccgg

SEQ ID NO: 5204 - DNA, 110 bp, Artificial Sequence
  Synthetic oligonucleotide
ctacgacaccaagcaggaggatgcctgccagggggacagcgggggcccgcacgtcacccgcttcaaggacacctacttcgtgacaggcatcgtcagctggggagagggct

SEQ ID NO: 5205 - DNA, 47 bp, Artificial Sequence
  Synthetic oligonucleotide
gtgcccgtaaggggaagtacgggatctacaccaaggtcaccgccttc

SEQ ID NO: 5206 - DNA, 110 bp, Artificial Sequence
  Synthetic oligonucleotide
ctcaagtggatcgacaggtccatgaaaaccaggggcttgcccaaggccaagagccatgccccggaggtcataacgtcctctccattaaagtgagatcccactcaaaaaaa

SEQ ID NO: 5207 - DNA, 312 bp, Artificial Sequence
  Synthetic oligonucleotide
gattgtccccactggcccctccgggagctgggacctccagaattggaggctgcgccacagaggggcgctgtctggtcggcccggtgtggctggcggcgtgcgggtgctcgcggtctcctgccgggctccccgcccccaggattctgcaggtgctcatcgctctctggccggcggtcagcgctaccgctcgccacgggaaacctacccactgcatgaggcaccagctagccacgtgaggctgtttctgtacacccgaaccgcgctcttgcccagcaaaagcggcagaacctcggctcccttccctaaataaga

SEQ ID NO: 5208 - DNA, 387 bp, Artificial Sequence
  Synthetic oligonucleotide
ggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtg

SEQ ID NO: 5209 - DNA, 226 bp, Artificial Sequence
  Synthetic oligonucleotide
cccaacagaaattcataaactttcttaaaccattatgagattttttttttgcaatttttttagcttatcagctatcattagtgttagcgtatattatgtgtggcccaagacaatttttcttcttccaatgttgcccagggaagccaaaagattggacccccttgattctagattgtgaaggatgcatcatctgacggcttttttttcctggtatgtgtgtgtaaag

SEQ ID NO: 5210 - DNA, 189 bp, Artificial Sequence
  Synthetic oligonucleotide
ttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaag

SEQ ID NO: 5211 - DNA, 408 bp, Artificial Sequence
  Synthetic oligonucleotide
aaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaagg

SEQ ID NO: 5212 - DNA, 177 bp, Artificial Sequence
  Synthetic oligonucleotide
aatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaag

SEQ ID NO: 5213 - DNA, 408 bp, Artificial Sequence
  Synthetic oligonucleotide
aaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcaatagtcagattcgttgcaaagctgataacacctgggatcctgaaataccagtttgtgaaaaag

SEQ ID NO: 5214 - DNA, 204 bp, Artificial Sequence
  Synthetic oligonucleotide
ttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctc

SEQ ID NO: 5215 - DNA, 178 bp, Artificial Sequence
  Synthetic oligonucleotide
tgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaag

SEQ ID NO: 5216 - DNA, 186 bp, Artificial Sequence
  Synthetic oligonucleotide
ccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaag

SEQ ID NO: 5217 - DNA, 186 bp, Artificial Sequence
  Synthetic oligonucleotide
aggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatccc

SEQ ID NO: 5218 - DNA, 278 bp, Artificial Sequence
  Synthetic oligonucleotide
cacaggttgggggttaggggagggatagtattaggagaaatacctaatgtagatgacgggttgttgggtgcagcaaaccaccgtggcacatgtatacctatgtaacaaacctgcacattctgcacatgtatcccagaacttaaagtataatttaaaaaaatgaaatcatccacaaaagtacttaccatgtgttgggaattatggaaagcaaacaactgctacattgaaacatggtcaatgagtaaagatattacatttttctttcttcttctgtttag

SEQ ID NO: 5219 - DNA, 760 bp, Artificial Sequence
  Synthetic oligonucleotide
tgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacataaaaaaaatg

SEQ ID NO: 5220 - DNA, 100 bp, Artificial Sequence
  Synthetic oligonucleotide
aggcacgctgtaaatctctaggacgatttcccaatgggaaggtaaaggagcctccaattctccgggttggtgtaactgcaaactttttctgtgatgaagg

SEQ ID NO: 5221 - DNA, 83 bp, Artificial Sequence
  Synthetic oligonucleotide
gtatcgactgcaaggcccaccttctagtcggtgtgtaattgctggacagggagttgcttggaccaaaatgccagtatgtgaag

SEQ ID NO: 5222 - DNA, 91 bp, Artificial Sequence
  Synthetic oligonucleotide
tggcagcgtgtgaagctacaggaaggcaactcttgacaaaaccccagcaccaatttgttagaccagatgtcaactcttcttgtggtgaagg

SEQ ID NO: 5223 - DNA, 77 bp, Artificial Sequence
  Synthetic oligonucleotide
gtacaagttaagtgggagtgtttatcaggagtgtcaaggcacaattccttggtttatggagattcgtctttgtaaag

SEQ ID NO: 5224 - DNA, 85 bp, Artificial Sequence
  Synthetic oligonucleotide
aaacatgccagcatgtgagacagagtcttcaagaacttccagctggttcacgtgtggagctagttaatacgtcctgccaagatgg

SEQ ID NO: 5225 - DNA, 83 bp, Artificial Sequence
  Synthetic oligonucleotide
gtaccagttgactggacatgcttatcagatgtgtcaagatgctgaaaatggaatttggttcaaaaagattccactttgtaaag

SEQ ID NO: 5226 - DNA, 11 bp, Artificial Sequence
  Synthetic oligonucleotide
ctgtgactcgc

SEQ ID NO: 5227 - DNA, 24 bp, Artificial Sequence
  Synthetic oligonucleotide
gttcacttgctcctgtcctttgtg

SEQ ID NO: 5228 - DNA, 76 bp, Artificial Sequence
  Synthetic oligonucleotide
gtattgctgcaggtttgatacttcttaccttcttgattgtcattaccttatacgtgatatcaaaacacagagaacg

SEQ ID NO: 5229 - DNA, 109 bp, Artificial Sequence
  Synthetic oligonucleotide
caattattatacagatacaagccagaaagaagcttttcatttagaagcacgagaagtatattctgttgatccatacaacccagccagctgatcagaagacaaactggtg

SEQ ID NO: 5230 - DNA, 271 bp, Artificial Sequence
  Synthetic oligonucleotide
aggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaa

SEQ ID NO: 5231 - DNA, 465 bp, Artificial Sequence
  Synthetic oligonucleotide
gtacagtttcagaacttactatttaacattcctctcaagcaaatacgccttgaaatgctttttttaaatcataggaatttaaaaacactttacaatagagaatgattgatttttaaaatatgtctgatttagctttgtagagatgttccgctaatatccataactaatctgagaggaaatgtggaacaacagaagagtaacagtgtctactcagtaacaagcgttttacgagttaaaaagacatccaaatgcagtactgaaaaatcagaagtcttgatttgtctcactgatgactccgtttttcctagagcagtctgtttaatgcttactggagataaatagatttataggtgaccaagacaatcgattaatgtatcagccacagacttttttaaatagaaaattttctaagtaggaaatcattcatagctctttgaaagatatagggagaggcctcaaggaaag

SEQ ID NO: 5232 - DNA, 163 bp, Artificial Sequence
  Synthetic oligonucleotide
aatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatg

SEQ ID NO: 5233 - DNA, 160 bp, Artificial Sequence
  Synthetic oligonucleotide
cttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcg

SEQ ID NO: 5234 - DNA, 621 bp, Artificial Sequence
  Synthetic oligonucleotide
gtgagtgagtcccaggacattcgagtggtcgatgaaaaacagaatcgtgatttactaaaaagcttttgccatcaactttatgccagaatttattttgaacccctaaaagacatttctataatagtactcctagttttcttcatgaaaaatacacttaaagcctaatttggatgcatttcatttatggtaaggagtctatcttttaataacactgtcagaaaaatatatatacttggctaatttcaaaagcgctacacttttaaattggcacttttgaaacagctgcaattggtatgattgtcagtgcccttcccagtctaaaaaatgttacagtctaacagaataaaaataaaaacctactctctctctctctaaataacagttccttacctaagacaaaatactcatgtaaaaagtcttatcctgctccatactggattttgaaatatttcaaggataaatctatcacataaggatttaaaaattatctgatctctaataaccaaatctgtgttctcatctttaaaaatttactagggaaatagattattaatttgtatattcagaaatatttgagatgatttagattttcatagtaaactgcatttatctggaatcaac

SEQ ID NO: 5235 - DNA, 160 bp, Artificial Sequence
  Synthetic oligonucleotide
cttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaag

SEQ ID NO: 5236 - DNA, 574 bp, Artificial Sequence
  Synthetic oligonucleotide
ggttctggagacttagggattggcaaaggttaaggtaaaactttactagtaacaatgagtgtggtaggatggaaataagtgtttagattacacgagacctgtaataacataaaagttacaataaaaatccaaccagcagtgtttccatcccagtggccaatttctgagcatagtcacgagagatgctttgtaggcaaacagaattgttctaagggacaaaatccccaacaggaaagaacacaccacaaacactcctgcttaaattaccatagtaacttaggatggctttactatatattgatttacataaagctgcatgttcttatactgtttattgccaaatgtccaatattacaatacactataaggtgcaactgagatttaatgaataaaatggaagtaacaatcctgcctcgtgatagttttagaagcacaaaaacattctgtgtcagattatctgctgtaccgagaaggcgaatcaatccttaatttctgagaacttgttttgtagaacataaagacgttatattgcctccaacactggtatcctaactaacagactatgccttcctag

SEQ ID NO: 5237 - DNA, 169 bp, Artificial Sequence
  Synthetic oligonucleotide
agtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatgg

SEQ ID NO: 5238 - DNA, 176 bp, Artificial Sequence
  Synthetic oligonucleotide
ggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacag

SEQ ID NO: 5239 - DNA, 123 bp, Artificial Sequence
  Synthetic oligonucleotide
ctccagaaagccaagatacccttagtgaccaacgaagagtgccagaagagatacagaggacataaaataacccataagatgatctgtgccggctacagggaaggagggaaggacgcttgcaag

SEQ ID NO: 5240 - DNA, 403 bp, Artificial Sequence
  Synthetic oligonucleotide
ggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggag

SEQ ID NO: 5241 - DNA, 1611 bp, Artificial Sequence
  Synthetic oligonucleotide
tccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattacctt

SEQ ID NO: 5242 - DNA, 245 bp, Artificial Sequence
  Synthetic oligonucleotide
agtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccag

SEQ ID NO: 5243 - DNA, 30 bp, Artificial Sequence
  Synthetic oligonucleotide
gaaaagcacccttattaagaattgcagcaa

SEQ ID NO: 5244 - DNA, 23 bp, Artificial Sequence
  Synthetic oligonucleotide
gtaagccaacaaggtcttttcag

SEQ ID NO: 5245 - DNA, 56 bp, Artificial Sequence
  Synthetic oligonucleotide
gatgattttcttatatcaagtggtacatttcattttatttacttcagtttctggtg

SEQ ID NO: 5246 - DNA, 107 bp, Artificial Sequence
  Synthetic oligonucleotide
gtttacttgtgtcctgaaagacagtgttacagaaacactgccaagagtgaataggacagcagcgatttctgggtattctttcaagcaatgctcacaccaaataagcg

SEQ ID NO: 5247 - DNA, 110 bp, Artificial Sequence
  Synthetic oligonucleotide
taacatttgtctactgaagcacacccaaacagggacaccaaccagaataacgaagctcgataaagtggtgtctggattttcactgaaatcctgtgcactttctaatctgg

SEQ ID NO: 5248 - DNA, 110 bp, Artificial Sequence
  Synthetic oligonucleotide
aaatctttgtctccttaaaacatctgagagtggattgcccagtacacgcattaaaaagagcaaagctctttctggtttcagtctacaaagctgcaggcacagcatcccag

SEQ ID NO: 5249 - DNA, 48 bp, Artificial Sequence
  Synthetic oligonucleotide
tgttctgccattcttcattttaccatgacactgatttcttgggagaag

SEQ ID NO: 5250 - DNA, 115 bp, Artificial Sequence
  Synthetic oligonucleotide
aactggatattgttgctgcaaaaagtcacgaggcctgccagaaactgtgcaccaatgccgtccgctgccagttttttacctataccccagcccaagcatcctgcaacgaagggaa

SEQ ID NO: 5251 - DNA, 88 bp, Artificial Sequence
  Synthetic oligonucleotide
gtaagccatatgaagggttatgcagacacccttgtcccgtctgcctgtgaggtgcattatgtttataccgttttgtttccaactgcag

SEQ ID NO: 5252 - DNA, 107 bp, Artificial Sequence
  Synthetic oligonucleotide
gggcaagtgttacttaaagctttcttcaaacggatctccaactaaaatacttcacgggagaggaggcatctctggatacacattaaggttgtgtaaaatggataatg

SEQ ID NO: 5253 - DNA, 53 bp, Artificial Sequence
  Synthetic oligonucleotide
agcttagaggcgctccgatgaaaatctctggatggctcaagacttcttaaaaa

SEQ ID NO: 5254 - DNA, 82 bp, Artificial Sequence
  Synthetic oligonucleotide
gcaagtcaattacgtcgtatctcatacattctgttttcctcacaataaatttccctaagacaagaaggagcattcggcacca

SEQ ID NO: 5255 - DNA, 96 bp, Artificial Sequence
  Synthetic oligonucleotide
attctcaacgacccatatgcctgccttccaaaggagatagaaatgtaatatacactgattgctgggtgactggatgggggtacagaaaactaagag

SEQ ID NO: 5256 - DNA, 96 bp, Artificial Sequence
  Synthetic oligonucleotide
aaaaatatatatatatatatatttatatgtatgcatatatgtttatgtgtattgtgtatggttattctacaaacgaaccaaaaaaatttttttcag

SEQ ID NO: 5257 - DNA, 17 bp, Artificial Sequence
  Synthetic oligonucleotide
acaaaatacaaaatact

SEQ ID NO: 5258 - DNA, 264 bp, Artificial Sequence
  Synthetic oligonucleotide
ctcaggctcgctctgcttcccggcggatctctcttcgccggcaccacggcgctgcgagcccccagcccgcccccacccttcctctcggccttttagctttaaatatttatcagcagcgccggcacgggctggagacgaggccgtttgtcttgcggaggaaggccggtgtttgcagagaatagccattagggtctcccccttctccccccttcccagctaaggatctcagccctgggtgtgtccccctgccccagctcggataag

SEQ ID NO: 5259 - DNA, 437 bp, Artificial Sequence
  Synthetic oligonucleotide
gaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagtttaaaaacattttttaaggaggga

SEQ ID NO: 5260 - DNA, 298 bp, Artificial Sequence
  Synthetic oligonucleotide
gtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccag

SEQ ID NO: 5261 - DNA, 61 bp, Artificial Sequence
  Synthetic oligonucleotide
gaaaggagaaattttggtttttcaacactgaaaaaatactacctataggaaagtctgtcag

SEQ ID NO: 5262 - DNA, 79 bp, Artificial Sequence
  Synthetic oligonucleotide
ccccatgctcccttttacattctgtgtgtatctaaaggatggaaaaataaaacgcaattaaaaataaaaaaaaacccta

SEQ ID NO: 5263 - DNA, 129 bp, Artificial Sequence
  Synthetic oligonucleotide
ggtgtccttgtttttcctgaagtgctctgacgacccttcgacattcacagcagacaacgccagcaggaatactggatgatggcgtttgacggtatttgcgggctgccattcccctgcatatctgtactg

SEQ ID NO: 5264 - DNA, 453 bp, Artificial Sequence
  Synthetic oligonucleotide
gtaaggaatgcctttctggcttcagcagcctggaggatggggacgtctgggcgttgactcctgggttggaacttttcagcccaccccttcccccagtctcttgccactgggtctctctgcttgggcctcagggatctctaggttcttcactccctctccaagcatcctcctccgggaagccttccctcactgagtccgtttccaatgggctggaactgcggtcccccgctgttctctgcggccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggtgcggagtgtccccgaggtcag

SEQ ID NO: 5265 - DNA, 965 bp, Artificial Sequence
  Synthetic oligonucleotide
gcaggaggagaggttatacctgcccttgaagacagcccagttgggggcagggagtggcagagagggccctcaaaaaggggtccattttggagatatttttcctggctgttggcctccgccacacatggggccgctggagggggcgagggcagacttgactggtgggtttgggaggagtgctgccaaagccaggaactcagggctggccctgctgggctgttctggccagggcccccttcctcagcttagacgaagtgtactcccacacccgcctccctcacgttctcctttccttcgccattcacccagaccggtcttttagatttcataggggcctccccaagctgctccaggcccaggttcccccatgtgttgagctgcaccgtcttactctctgtggtccccagggcctggggccctgagctgctggttttgcagaggcctctattgcctcccacctccagtcataccggctactccttaagggcctttgtgggctccaggctggggtcattttaccatggattgactgtcctgaggccttgctggagaaaggggaaggagagaaaggatattgaggaaggaagagaagaggtcccagacagaagggagggctgggcctggtcatcctcatgatccattgacaggaagaggtggctgttcagatagggaggtggagaacaccacctgtaatgtgatggggagtgaagtggagaggaggccctggagcacattcgtcgagagtcaaccacggggcacttccgtgcaccaggcagacctgcttcctggatcactctgtaggacacttgatttggagtccaaagggagagggctggaagccccaggcagggaaacagccagggggagcatggctctgctaagtggctaaagatgatgttcctcaatcccgctgtgggtggcacgctctggctcctcttgagtttcctccttctcgcccgttctag

SEQ ID NO: 5266 - DNA, 2023 bp, Artificial Sequence
  Synthetic oligonucleotide
gtaatgccccctgtgccacatgcgaagacccctgccccgggccaatgtgaccctcatgagctgaccctgtgcaagtccccctgcttcaggaatcagcatgcagctgctcagtccaataactccctgaggggccagtcttgaccaacacatttcctgcctttcctctctcctctttgtccctgggggctgtttccaaatcattctggtcttttcccctgactcagtcccagtgaaatgtctcagcccagccctgacctgcactgtctcctttgggtgtctgaccaaggccccgagagagagtagggcagaaagtgtcttctgacaggggtgcttcagaactggtatgaccttcacagattattctagagcaactctcttttgttcaggtgaggaattagagaccagagaagtttagggacttggttgagctcacactgcaaaggtcactgggagagctgggacttgaattttaggtccctgactcctaggagaggacacagagccaacttgggaagcaaagaagcagagagggaaaatggtcattgtgagccatgcgagggccgcagaggctgagggtgggtctggtcatggcaggagccagaaggaggctcaggaaggctgggactggggcttttgaggacaggtctttttgcactcttttctcattgaatagaaacaaaagcctgaagctcaggctgggccccaccctggcacacctgaggggcactggggcagtgagtgagttctgtcccctgcctgtggctgtgtgactaagcaggagtcacacattggctctgactggaggagagcaaacaaggtctctgtggagtgcccccccccaacactcccacttccctagggcaaaagtcaacaggattagtcccatagcaggtggaaccagacaggtgcagagtagggaaggtgtggggccatcattcagcccctgttgtcaggactaacgtgtgtgcatgcgtgtgtgcatacctggtgcccacccccatactccccccaccccaaaccctcagagcaccttcctgtggagccagtctgagatccaggctgggactgaaagaggaactggaagggagtccagggaaggagtacagggagggtccctgtgtgcagctgctcagggagttccgatctgtgcaccctcttgacctggctgtgcactgccaaggcaggggtggacggaaagccttgcagatattttccagcttctacagaacttgagggagtgcaactttgagggtatgggcacctccaaccctgagtctgggctcctgaaggggcttggcctacctggatgtcctgccttccaccccaggttgtccctactgcttccagcagctcttggaactcttgtttccaacacctttttttgagtctcaacataaacattagattaagccattgtggtctcttcctctgtgccttgtttgcccaggtcctcctaagggccaggagtggctccttgggaggaagagtgatgggagctatgggaggaaggatgggggctggatcatcaggcgggacctggttctttcaggactttgtgtatccctcatcctgattctacagggttcctccccttcagactccttctttgcccctgaggggtgggattaggtagtgattagggcatggctggagtcagctgccaaggttcaagtctgggctgtgccacttagcagcttagtgacctgggcagattacgctgcctctctgtgtctctgttcccttctctgataaccacagtaccatcgttataggtttgctgtgaggatgaaatgagctcatgcataagaagcacataatggtgcacaccccatagaacacagtctcatgcatatggctgttattatttgctttttttctcccaggacatgcagcttttgtgctgtcattcacatgtttcctatgtgccccaccaacaaccccccatgccaagactcaaagccctaggaatggccgcgtggaagtcagggaaatttggttttgtagctgacacctgttttttcag

SEQ ID NO: 5267 - DNA, 150 bp, Artificial Sequence
  Synthetic oligonucleotide
gtgagtgggaaagacaggctcgaggagggttgtctgaaaacatatgggacaaaggaccacaggatcctctcacctgagcagcccatggggacctctggccaaggcctgcctgagctgtccaagaggaagtctgcacagcctgtcctgtgg

SEQ ID NO: 5268 - DNA, 788 bp, Artificial Sequence
  Synthetic oligonucleotide
gtgttgcttggctggcctgaaatgtttgctgaatgaatgcaatgagctgcctcgagccagcatgagctctctgttcctgcagatgtgcaagcttggaacgccttagaagtatcttaggggtcttgtctacatgccctttaagattctcttcaatacactgagcagttggtgttccaggccaaaccacagaattgcaacttgcccctgggagctgggcccttggagattcaggaatgagtaaaagtgaggcctgtccgtaggagtttaagcttgagaaagtgcagctggaagaggctcagacaccatcttcacctggggtgttatctgaggcccacctgcatcatagttaccatgctgcaaattaaaaacatagcttggagattttccatctctgggagcggggctgggaatctgaatgactttgtgttctgctactgactgacgaaaagttgagctcccagagttgaagtgatttgttccaggtcacacggttagtaggtggagctagtggtgttgaaaccatctaggtctttaggaactggtcaagtgctaggttggggcttcagttgctctgggataccagtgctgatgcccaccatgcagtctggagggtcagcagggcaagcttcatgctgtgaccatgtacagcagctgtagaaactgtttctgggtagggcagtagtatttggcctgtgggttggacagggcaggcctgcttccacccctactaaatgttccctgtactgaggacatggtctccctctgccccatcttgccccaacccccag

SEQ ID NO: 5269 - DNA, 121 bp, Artificial Sequence
  Synthetic oligonucleotide
agaagattcccacccctgcctcccatgcctggtcccaagacagtgagacagtctggaaagtgatgtcagaatagcttccaataaagcagcctcattctgaggcctgagtgatccaaaaaaa

SEQ ID NO: 5270 - DNA, 890 bp, Artificial Sequence
  Synthetic oligonucleotide
agtctgcaaactacggccacatgcaggcttcctgtttgtcaatcaagttttcttggaacccagtcataccgcttccttcaagtattgcctttggctgtggctgctttacatgacaacggagtggagcagttgaggcagagactacatggcccacgagcctaaagtttttactatctgaagctctaagaaaaagtttgcctgcccagaaccccaagctgttatttcaggacccacaaaatggattacttacagacatttacagcaccaacgccctcacacaaccttatagggaaagcaaagagacagaaattagttgtggggagcaaagctggtgaaatctgtttaacctgcaaattctctcctccaattagcgttgatgcacattccaagtaaataatatgcagacatgctcctgggtgttgaagcactgcagcactgcctgggggaaactgaggggacaccctccccacagctgtggtcctcacctctgctcctcgccctccagcaggcgcctgtaggtggcgatctcaaagtccaggccagcttggagttcatcacctcctggtactccctgatcaggcaggccatgtcctgcttggccttctgcagggcaccctccagctcggccagcttgcagcgggcatcactgagggccgcctcaccctgctgctcagactgggccaccgcggcctccagcttggagttctgggaggcaagggagggttattaaggatctctgttctggcttcagggtcagaggccaggtaaccactgaccactgactagcagaagaaaaagaggccttgtctatttgttaggccaggggttgcaaattagtgctcccaggcatgtttgcacagtgtcttcaattttggaaatttaacacaata

SEQ ID NO: 5271 - DNA, 33 bp, Artificial Sequence
  Synthetic oligonucleotide
agaaagtgccctgattccagagagcaggagaag

SEQ ID NO: 5272 - DNA, 104 bp, Artificial Sequence
  Synthetic oligonucleotide
ggaaggaacgcagccagggaaactagctgggccaggaggggtcagacccctgaacaagtgagctgatctctcaaggaggagctggatcggtgtgagggagagcg

SEQ ID NO: 5273 - DNA, 99 bp, Artificial Sequence
  Synthetic oligonucleotide
cgagtgcgcgctcctcctcgcccgccgctaggtccatcccggcccagccaccatgtccatccacttcagctccccggtattcacctcgcgctcagccgc

SEQ ID NO: 5274 - DNA, 28 bp, Artificial Sequence
  Synthetic oligonucleotide
cttctcgggccgcggcgcccaggtgcgc

SEQ ID NO: 5275 - DNA, 75 bp, Artificial Sequence
  Synthetic oligonucleotide
ctgagctccgctcgccccggcggccttggcagcagcagcctctacggcctcggcgcctcgcggccgcgcgtggcc

SEQ ID NO: 5276 - DNA, 60 bp, Artificial Sequence
  Synthetic oligonucleotide
gtgcgctctgcctatgggggcccggtgggcgccggcatccgcgaggtcaccattaaccag

SEQ ID NO: 5277 - DNA, 12 bp, Artificial Sequence
  Synthetic oligonucleotide
agcctgctggcc

SEQ ID NO: 5278 - DNA, 60 bp, Artificial Sequence
  Synthetic oligonucleotide
ccgctgcggctggacgccgacccctccctccagcgggtgcgccaggaggagagcgagcag

SEQ ID NO: 5279 - DNA, 42 bp, Artificial Sequence
  Synthetic oligonucleotide
atcaagaccctcaacaacaagtttgcctccttcatcgacaag

SEQ ID NO: 5280 - DNA, 27 bp, Artificial Sequence
  Synthetic oligonucleotide
gtgcggtttctggagcagcagaacaag

SEQ ID NO: 5281 - DNA, 20 bp, Artificial Sequence
  Synthetic oligonucleotide
ctgctggagaccaagtggac

SEQ ID NO: 5282 - DNA, 16 bp, Artificial Sequence
  Synthetic oligonucleotide
gctgctgcaggagcag

SEQ ID NO: 5283 - DNA, 96 bp, Artificial Sequence
  Synthetic oligonucleotide
aagtcggccaagagcagccgcctcccagacatctttgaggcccagattgctggccttcggggtcagcttgaggcactgcaggtggatgggggccgc

SEQ ID NO: 5284 - DNA, 53 bp, Artificial Sequence
  Synthetic oligonucleotide
ctggaggcggagctgcggagcatgcaggatgtggtggaggacttcaagaataa

SEQ ID NO: 5285 - DNA, 119 bp, Artificial Sequence
  Synthetic oligonucleotide
gtgtgtctttaaagagtaggggaagggaggcagggcagatttcacagctgcatatggcggaggggggacgggagcatggaggcaaagctgcatcaacaccaggccctcctctactgtag

SEQ ID NO: 5286 - DNA, 32 bp, Artificial Sequence
  Synthetic oligonucleotide
gtacgaagatgaaattaaccgccgcacagctg

SEQ ID NO: 5287 - DNA, 6 bp, Artificial Sequence
  Synthetic oligonucleotide
ctgaga

SEQ ID NO: 5288 - DNA, 23 bp, Artificial Sequence
  Synthetic oligonucleotide
atgagtttgtggtgctgaagaag

SEQ ID NO: 5289 - DNA, 18 bp, Artificial Sequence
  Synthetic oligonucleotide
gatgtggatgctgcctac

SEQ ID NO: 5290 - DNA, 44 bp, Artificial Sequence
  Synthetic oligonucleotide
atgagcaaggtggagctggaggccaaggtggatgccctgaatga

SEQ ID NO: 5291 - DNA, 34 bp, Artificial Sequence
  Synthetic oligonucleotide
tgagatcaacttcctcaggaccctcaatgagacg

SEQ ID NO: 5292 - DNA, 69 bp, Artificial Sequence
  Synthetic oligonucleotide
gagttgacagagctgcagtcccagatctccgacacatctgtggtgctgtccatggacaacagtcgctcc

SEQ ID NO: 5293 - DNA, 22 bp, Artificial Sequence
  Synthetic oligonucleotide
ctggacctggacggcatcatcg

SEQ ID NO: 5294 - DNA, 9 bp, Artificial Sequence
  Synthetic oligonucleotide
ctgaggtca

SEQ ID NO: 5295 - DNA, 49 bp, Artificial Sequence
  Synthetic oligonucleotide
aggcacagtatgaggagatggccaaatgcagccgggctgaggctgaagc

SEQ ID NO: 5296 - DNA, 16 bp, Artificial Sequence
  Synthetic oligonucleotide
ctggtaccagaccaag

SEQ ID NO: 5297 - DNA, 9 bp, Artificial Sequence
  Synthetic oligonucleotide
tttgagacc

SEQ ID NO: 5298 - DNA, 21 bp, Artificial Sequence
  Synthetic oligonucleotide
ctccaggcccaggctgggaag

SEQ ID NO: 5299 - DNA, 69 bp, Artificial Sequence
  Synthetic oligonucleotide
catggggacgacctccggaatacccggaatgagatttcagagatgaaccgggccatccagaggctgcag

SEQ ID NO: 5300 - DNA, 27 bp, Artificial Sequence
  Synthetic oligonucleotide
gctgagatcgacaacatcaagaaccag

SEQ ID NO: 5301 - DNA, 20 bp, Artificial Sequence
  Synthetic oligonucleotide
cgtgccaagttggaggccgc

SEQ ID NO: 5302 - DNA, 11 bp, Artificial Sequence
  Synthetic oligonucleotide
cattgccgagg

SEQ ID NO: 5303 - DNA, 5 bp, Artificial Sequence
  Synthetic oligonucleotide
ctgag

SEQ ID NO: 5304 - DNA, 39 bp, Artificial Sequence
  Synthetic oligonucleotide
gagcgtggggagctggcgctcaaggatgctcgtgccaag

SEQ ID NO: 5305 - DNA, 58 bp, Artificial Sequence
  Synthetic oligonucleotide
caggaggagctggaagccgccctgcagcgggccaagcaggatatggcacggcagctgc

SEQ ID NO: 5306 - DNA, 19 bp, Artificial Sequence
  Synthetic oligonucleotide
gtgagtaccaggaactcat

SEQ ID NO: 5307 - DNA, 16 bp, Artificial Sequence
  Synthetic oligonucleotide
gagcgtgaagctggcc

SEQ ID NO: 5308 - DNA, 53 bp, Artificial Sequence
  Synthetic oligonucleotide
ctggacatcgagatcgccacctaccgcaagctgctggagggcgaggagagccg

SEQ ID NO: 5309 - DNA, 35 bp, Artificial Sequence
  Synthetic oligonucleotide
gttggctggagatggagtgggagccgtgaatatct

SEQ ID NO: 5310 - DNA, 41 bp, Artificial Sequence
  Synthetic oligonucleotide
ctgtgatgaattccactggtggcagtagcagtggcggtggc

SEQ ID NO: 5311 - DNA, 64 bp, Artificial Sequence
  Synthetic oligonucleotide
attgggctgaccctcgggggaaccatgggcagcaatgccctgagcttctccagcagtgcgggtc

SEQ ID NO: 5312 - DNA, 111 bp, Artificial Sequence
  Synthetic oligonucleotide
ctgggctcctgaaggcttattccatccggaccgcatccgccagtcgcaggagtgcccgcgactgagccgcctcccaccactccactcctccagccaccacccacaatcaca

SEQ ID NO: 5313 - DNA, 180 bp, Artificial Sequence
  Synthetic oligonucleotide
gggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccag

SEQ ID NO: 5314 - DNA, 349 bp, Artificial Sequence
  Synthetic oligonucleotide
gtatgtgtgagcaccaggaaagggcacaccgatcctggactgcagagccgtgcgcatgtgctgggaagaagcaccggccaggagtcacaggaaagagggattcaggctctgactctaacattgactttttgggtgattttgagcaagtctttggcctgctctgggctccggctccctctcttgtcaaatgagggggttcctttaagagcaggagtttgtaactttccttgcatcacaccgcctccttctgaaaagcagaagagagcatgggttctctccctagagtttcacatgctatgcaggggctttgagatcccactaaagctgggctgtgaatgctaggttaaag

SEQ ID NO: 5315 - DNA, 2473 bp, Artificial Sequence
  Synthetic oligonucleotide
cagcactttgggaggctgaggcgggcagatcagctgaggccaggagttcgagaccagcctggccaacatgttgaaaccccatctctactaaaaatacaaaaattagccagatgtggtggtgtacacctgtaatcccacctacttgggaggttgagacatgagaatcacttcaacctgggaggcagaggttgcagtgagccaagattgtgcaactgtaccccaccctgggtgacacagtgacactctgtctcaaaaaaaataaataaataaataaagaccttgcaccagattttgaaaatgttcaagatcccagtggagaaagagtttctaaaagaggatggtagaagcagttcttcacagaggagttccctcctaattaccacggatcaagggaatgatagttgcaggtgtctgtagagtagatggagacatctgccatcacaggagggattgtgagatgttgggggcaggcaagaaaggagggacaggctctggttaaatttctggagggggctcagggttgacgggggtcatgtccttgcctgtgcccctctcccttgcagccagaggccagcacagccatccaggggacaccaggcccccacttcccagccccaaaatagcctcacccatgtgtttccctcaaaaagggctagaaggctattaccccaatgcccctgctacccccagtctccaaaaagtaatttgcgatctacagggacttacagctaggtgtgatgtcagctgttgccaggcagaaaggggtttgggagaaccctgcagagatgttatgacaagctatgttctggggaacaaggtaacctgctgcagaccattagagctgtggcctgtgaaaaccccagggaatcccatggcaaggagggagactgttttgtgaggaatggattcaggtctaggccacgcgtgaccttggataaatcactgcctctccctgagtctcagtaataatataatagccataatagttctcatccactgtgtacctgtcaccaggcctcagccactgttagttagtactgtgattatttacatacgtaaaggctaaactcaattttaattcttacagtcaccctatgaatcaggtacttttgttgtccctttttacagaagaggaaattgaggtcatattggtaagtgacttacccaagtaatcatagctagtgagtggttggaggcagaatttgaaccaggactagtctgacatcaaagtgttagctcactccaccatttggccccctttcagaggtgcatttgtgggaaggggaggtgagacccctctgagctcagaccactcagtgatttacagacccaggtgggctcagtgttcagagtgcatgtccccttgtctaatccttgtctagttttccctttattcagttactgcttctaaagctggctatgtgtgcttaggccattccagactggagcctgttttggaggcttttgtgaatgcttctgcctggcaacatctgtgtcacgattcctgctagctctggttggctcctgactttggcttttttttttttttttttaattgcagaagaaggtagtgtaaatgaggaaataaagaggggggtgacaagagttggcactctaccagaaccaggggacaggcgttcaagatgcataaagaggaagaaaagcagatgctaaacttaactacgaactcccctgagaattgcactgagtgtaatttatttatagagtgctaacaatgtgctaggtgtggagccaagagctttaccctcatcatcttatttaatgtaacagcccttggagcagatgttttacccgattttactcacacagagggttaatcaacttagatggtcccagaactaaccgactccagagccaggattccaatccaggttatgtggtctcgtcttcagggtgaatctctaggttcttaggcctcctgaggaactgtggtgcagagaggggaaggtactgtcccatgtcgtgtgtgggaggtagagctggggctagaattgggtgtggggttgcagaagcactgaacaggtggaggatgaggctggagagcctgaacacaggctaggccacccgtgttccttgagaaggccaagaagtagaatttgttttcccttcctgtctggtctccccacttcccccccgccccccgcccaccgtcgggtttttgctgtttccttcccgaataactctcccttgggctgggccttatcccagaaagcacagactggcacgcagcaagccaatgagaatgagccagtctgtgatgtcatgagttaccaggcacaagggactcctggagcgtcctaaaccatccttgctggttgctggagtaggcagggtgcagcctcatccttgcagttcccaatgggtctgttttagtccgttttgtgccgctttaacagaataccacagactgcgtaatatacaaacaaacaaacaaacaaacaaaaaacaccca

SEQ ID NO: 5316 - DNA, 141 bp, Artificial Sequence
  Synthetic oligonucleotide
tgctgggattacaggcgtgagtcaccacacccagcctggtgaggggcttccttgatgtgtcctcatatggtggaaggcagaagggcaagagagaaccaactccttccatcaagccgtcttacagggcacctaatcccattc

SEQ ID NO: 5317 - DNA, 191 bp, Artificial Sequence
  Synthetic oligonucleotide
gtgcgtgcacccctacatcctgataccccccacctcccaccatccctcaactcagagacccgcatccctgcacccagctgggcccactgtcctctccctccggtttggaattccagcccttcctcatctgggtctgataccctcctccctgggcaccggggccacacttaccctcgttcctgtccccacag

SEQ ID NO: 5318 - DNA, 547 bp, Artificial Sequence
  Synthetic oligonucleotide
gtaaggacagccccagggtggtgggaggggcaaggttatcccgcctggatggaggacagtgccaaggggaggggcagggaagagagcccacctggggaggggtcctgactgctgcgggagggacagtgcctgcctcaggaagaatcgggctccccaggtgtggagggcacaggtgaagagtctcttggtgccatccctgggaggaaggctcagccctctacagtttacaaagtgcttctcatttcctatagcatctcactgtcctctcccattctcaaagaccttgctatcatgcattgacaatatttatattcacaatactgtgctgtggacaaaaccctgggcaggaaagcttatgccagtttgaccaatgaggacattgaggcaggaagctaaagtgacttgctcgagctctcatgtttggaggtggcagagatggaaccattgaccaagtgcctgcgattccagtctcttacctagatcccagcaaccggctcctgctccataccccctgctccagggaccagctctggtaaccttctgttac

SEQ ID NO: 5319 - DNA, 176 bp, Artificial Sequence
  Synthetic oligonucleotide
gtgagtgcagggagctagctgggtggtcctgcctgcccacccaggaccctggccgggccaagctccaaggcctgtatacctggctcatggcagactttcaacatgtgctctctggattactgaatacaagggtgacccttaaatgttatatgtagtctggcctctgcatttttgag

SEQ ID NO: 5320 - DNA, 354 bp, Artificial Sequence
  Synthetic oligonucleotide
gcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggctcaaagtttggaagtgacttgctcaagacaccctttttttctccccaaatttgtactgcgtgtctgtcctatgccag

SEQ ID NO: 5321 - DNA, 491 bp, Artificial Sequence
  Synthetic oligonucleotide
cactgtgcaaggctctgggcccacaatggggagcaattggacccagctcctgaagccatggggatcccaggctagtgtgggagacagacaagtgaccaggtgatgacagaagtgcagggggctttgtgaagaaagaggcagaggactcaacctagctgggggcagtcaaggttgggtcctcacctgctggagcaggtaagacctgaaagctgagcagccatccacagggaggacactggggcttgttggtagagctggcctggaatctggaactcgactcgcaacgctgcagtctcgtagctgaacagctggactacccttacccgtaccctcccctcccctcccatcatggctgaagtccagggtttaggcttggtgtagctctggtccattcctcagaatggaagaccaagggaacgtgggctacacatttcacactgcctgccagggagctcttcttgaaccatccttcctgccctgctaccctgtag

SEQ ID NO: 5322 - DNA, 317 bp, Artificial Sequence
  Synthetic oligonucleotide
gtcagcaggtttccctgcatgggaactctctctttcctctggtgtctagggcagggctaggagaggtggggtgagggtgggctggggaagccattctcaggaagctgaaggggtttaccagcacttccaaaacctggatgctgcagagtatgtggggttcagccccaggggtctttaagagggaaccaggctgcagctggacccgggtgttggggccctatttggccctgcatgtttctgtccccaggggcaaagccaggcagtgtaggggcttggtggtggccatcgaacctgacctccacctctatccgtattag

SEQ ID NO: 5323 - DNA, 456 bp, Artificial Sequence
  Synthetic oligonucleotide
gtgggagctttagcgtgccagggcttctggaccctcggggctctcctgaagctgctgaggccggggcctccagcactccctggtcccagcaccgcggaatctcccatcctctcagctctcacttctttctcacttctctctctctcctgtctgttccttcttggtttggctgtccccctcccctgacccacccccatcttgtctaagggttcctaagggcccacagaggcctgtcaccacagggtacaggtgacctctctcatagaggatggtacagcacagggtgcctggggtagaacctgcccgaaacactgcagaaaggaatccttgtaatgaccttgccccagtgctgcccgcaatccagtgagggcgccaaggtcacagctgctgccaagagagccttgggcgtttcccacctcatggacaatgcagactaggatgtttttagacccaaag

SEQ ID NO: 5324 - DNA, 575 bp, Artificial Sequence
  Synthetic oligonucleotide
gtgctgtctctaatttgctatgtaactttggacaagtccccttccctctaggattcagggtcctgaagtagaaggtcaaagggccaccctgcctggggcctcagtttctgcatcagattcatagaaggcaccttacatgctatctccaactcctagctgatgcttaaacccctctaagacatctccaacaaacggtaaaccccatttctacttgagaactcccagtaacaggaagcttagacttaccaaggtgcccattgcttttctctagaatcagaatcgcaagtgcaattccaaactgtaatggtgtttttttgtttgattgtttgtttttgagatagagtctggctctgtcgcccaggctggagtgcagtggtgcgatctcagctcactgcaacctcagcctcccgggttcaagcaattctcctgcctcggcctcccgagtagctgggattataggcatgtgccaccacgcccagctaatttttgtatttttagtagagacagggtttcaccatgttggccaggctggtcttgaactcctgacctcaagtgatccgcccacctcggcctcc

SEQ ID NO: 5325 - DNA, 284 bp, Artificial Sequence
  Synthetic oligonucleotide
atgagccactgtgcctggcccaaaactgtaatgggctttgagtgtcagaagaaaccatcaacttctgaggtgaattggacacatggccattcacttcctttttgatctcagaccttgttggtctaggcctcagttttcccatccgtgtgatggctggagtgagtaaagccacttgggaagaaggcattaagcccacagcagtggtgtgtgggtctttagctctgctcagaccctggttcagagctcactcactcactgtgtcctcatcatgcctgtcgcttcag

SEQ ID NO: 5326 - DNA, 495 bp, Artificial Sequence
  Synthetic oligonucleotide
gtaagcagtggcactgtgccagtgtcagaggaccaggaaggactaggaaggttgaggggcaagaggtcccctctgaagcacatgggaccaggacacccaggatggcagctcctgggggcagtgacgtagtcatgcgtccagccctttatccatccacccacctgtgcattcctatttgtccatttatcatctctcctcttacatgcactcatatttgttcacttatccgtcagtcctttcatctgtgaatttcatccatccacgcgccatcctctagcatccaggagtcctacagacccacccatctcatttcatcacccccttctcactcgagcccccattacacctctttgttgctgcttgcagctgtccttccctgggtacctgctttcccaggcactaagcctgtggctaggtgggaagcactgccctcaggcatcttgggtcaggtaggctgcacttcaagtgacaaacggacttgctgctcctttgcag

SEQ ID NO: 5327 - DNA, 240 bp, Artificial Sequence
  Synthetic oligonucleotide
gtgaaggagtgtgacgctgggccactctccaacattcctgggatgtccatttcacagacgaaggaacagggttggggggctgtggggagttacacaaatccatgatggtcattattggacctgagcagggggcaggggagggtggacagtccttaactgctctgcaggtccaggatgttagaaaggggcagggacaacaaatgggtgaccccaacctcaacctgctgcttctctctccag

SEQ ID NO: 5328 - DNA, 473 bp, Artificial Sequence
  Synthetic oligonucleotide
ccctagttccctctgctcagccaagcttgttatcagctttcagggccatggttcacattagaataaaaggtagtaattagaacaaaatggctcctggctcttctgttgagatccagttcatttatcctaaagaggtaactaaagacgctaaatccagtcactgaggtgggagaacgcagcccaagtaacccacagagatgcctgcggggccaggcaggcctgggggggggcttgtagtctttggacacagacatacttgattacatgtttaacacacacgaacactctacttccaaaaagaaataggctcttgcctagtttaagcacaagctcttcttggtacagctttcattttcctatgtccccaatttcatttctatactaagaacagtgtgaatgtgatgacagatggcaaccgacatagggcctccgtgtcaggatggacaggaagtagggaacttggggtcactggg

SEQ ID NO: 5329 - DNA, 45 bp, Artificial Sequence
  Synthetic oligonucleotide
atgcacaggaggagaagcaggagctgtcgggaagatcagaagcca

SEQ ID NO: 5330 - DNA, 34 bp, Artificial Sequence
  Synthetic oligonucleotide
gtcatggatgaccagcgcgaccttatctccaaca

SEQ ID NO: 5331 - DNA, 17 bp, Artificial Sequence
  Synthetic oligonucleotide
atgagcaactgcccatg

SEQ ID NO: 5332 - DNA, 18 bp, Artificial Sequence
  Synthetic oligonucleotide
ctgggccggcgccctggg

SEQ ID NO: 5333 - DNA, 11 bp, Artificial Sequence
  Synthetic oligonucleotide
gccccggagag

SEQ ID NO: 5334 - DNA, 42 bp, Artificial Sequence
  Synthetic oligonucleotide
gccttggaacaggctgtgcctggtggctcccgcctgtaatcc

SEQ ID NO: 5335 - DNA, 19 bp, Artificial Sequence
  Synthetic oligonucleotide
caagtgcagccgcggagcc

SEQ ID NO: 5336 - DNA, 11 bp, Artificial Sequence
  Synthetic oligonucleotide
ctgtacacagg

SEQ ID NO: 5337 - DNA, 19 bp, Artificial Sequence
  Synthetic oligonucleotide
cttttccatcctggtgact

SEQ ID NO: 5338 - DNA, 10 bp, Artificial Sequence
  Synthetic oligonucleotide
ctgctcctcg

SEQ ID NO: 5339 - DNA, 8 bp, Artificial Sequence
  Synthetic oligonucleotide
ctggccag

SEQ ID NO: 5340 - DNA, 11 bp, Artificial Sequence
  Synthetic oligonucleotide
gccaccaccgc

SEQ ID NO: 5341 - DNA, 7 bp, Artificial Sequence
  Synthetic oligonucleotide
ctacttc

SEQ ID NO: 5342 - DNA, 9 bp, Artificial Sequence
  Synthetic oligonucleotide
ctgtaccag

SEQ ID NO: 5343 - DNA, 12 bp, Artificial Sequence
  Synthetic oligonucleotide
cagcagggccgg

SEQ ID NO: 5344 - DNA, 20 bp, Artificial Sequence
  Synthetic oligonucleotide
ctggacaaactgacagtcac

SEQ ID NO: 5345 - DNA, 25 bp, Artificial Sequence
  Synthetic oligonucleotide
ctcccagaacctgcagctggagaac

SEQ ID NO: 5346 - DNA, 22 bp, Artificial Sequence
  Synthetic oligonucleotide
ctgcgcatgaagcttcccaagc

SEQ ID NO: 5347 - DNA, 20 bp, Artificial Sequence
  Synthetic oligonucleotide
ctcccaagcctgtgagcaag

SEQ ID NO: 5348 - DNA, 21 bp, Artificial Sequence
  Synthetic oligonucleotide
atgcgcatggccaccccgctg

SEQ ID NO: 5349 - DNA, 21 bp, Artificial Sequence
  Synthetic oligonucleotide
ctgatgcaggcgctgcccatg

SEQ ID NO: 5350 - DNA, 18 bp, Artificial Sequence
  Synthetic oligonucleotide
ggagccctgccccagggg

SEQ ID NO: 5351 - DNA, 12 bp, Artificial Sequence
  Synthetic oligonucleotide
ttcctcccacag

SEQ ID NO: 5352 - DNA, 30 bp, Artificial Sequence
  Synthetic oligonucleotide
cccatgcagaatgccaccaagtatggcaac

SEQ ID NO: 5353 - DNA, 9 bp, Artificial Sequence
  Synthetic oligonucleotide
atgacagag

SEQ ID NO: 5354 - DNA, 24 bp, Artificial Sequence
  Synthetic oligonucleotide
gaccatgtgatgcacctgctccag

SEQ ID NO: 5355 - DNA, 57 bp, Artificial Sequence
  Synthetic oligonucleotide
ataaacaggctcggctgggtgcagtggctcatgcctgtaatctcagcactttgggag

SEQ ID NO: 5356 - DNA, 24 bp, Artificial Sequence
  Synthetic oligonucleotide
aatgctgaccccctgaaggtgtac

SEQ ID NO: 5357 - DNA, 7 bp, Artificial Sequence
  Synthetic oligonucleotide
ccgccac

SEQ ID NO: 5358 - DNA, 23 bp, Artificial Sequence
  Synthetic oligonucleotide
tgaaggggagcttcccggagaac

SEQ ID NO: 5359 - DNA, 20 bp, Artificial Sequence
  Synthetic oligonucleotide
ctgagacaccttaagaacac

SEQ ID NO: 5360 - DNA, 22 bp, Artificial Sequence
  Synthetic oligonucleotide
catggagaccatagactggaag

SEQ ID NO: 5361 - DNA, 30 bp, Artificial Sequence
  Synthetic oligonucleotide
gtctttgagagctggatgcaccattggctc

SEQ ID NO: 5362 - DNA, 32 bp, Artificial Sequence
  Synthetic oligonucleotide
ctgtttgaaatgagcaggcactccttggagca

SEQ ID NO: 5363 - DNA, 14 bp, Artificial Sequence
  Synthetic oligonucleotide
aaagcccactgacg

SEQ ID NO: 5364 - DNA, 6 bp, Artificial Sequence
  Synthetic oligonucleotide
ctccac

SEQ ID NO: 5365 - DNA, 6 bp, Artificial Sequence
  Synthetic oligonucleotide
cgaaag

SEQ ID NO: 5366 - DNA, 9 bp, Artificial Sequence
  Synthetic oligonucleotide
gtacaggga

SEQ ID NO: 5367 - DNA, 22 bp, Artificial Sequence
  Synthetic oligonucleotide
acagagtgctgtttctatcccg

SEQ ID NO: 5368 - DNA, 12 bp, Artificial Sequence
  Synthetic oligonucleotide
caaagtgctaag

SEQ ID NO: 5369 - DNA, 9 bp, Artificial Sequence
  Synthetic oligonucleotide
attacaggc

SEQ ID NO: 5370 - DNA, 28 bp, Artificial Sequence
  Synthetic oligonucleotide
tactgaccaagtgccaggaagaggtcag

SEQ ID NO: 5371 - DNA, 33 bp, Artificial Sequence
  Synthetic oligonucleotide
ccacatccctgctgtccacccgggttcattcag

SEQ ID NO: 5372 - DNA, 93 bp, Artificial Sequence
  Synthetic oligonucleotide
gcccaagtgcgacgagaacggcaactatctgccactccagtgctatgggagcatcggctactgctggtgtgtcttccccaacggcacggaggt

SEQ ID NO: 5373 - DNA, 5 bp, Artificial Sequence
  Synthetic oligonucleotide
cccca

SEQ ID NO: 5374 - DNA, 33 bp, Artificial Sequence
  Synthetic oligonucleotide
acaccagaagccgcgggcaccataactgcagtg

SEQ ID NO: 5375 - DNA, 20 bp, Artificial Sequence
  Synthetic oligonucleotide
agtcactggaactggaggac

SEQ ID NO: 5376 - DNA, 30 bp, Artificial Sequence
  Synthetic oligonucleotide
ccgtcttctgggctgggtgtgaccaagcag

SEQ ID NO: 5377 - DNA, 13 bp, Artificial Sequence
  Synthetic oligonucleotide
gatctgggcccag

SEQ ID NO: 5378 - DNA, 72 bp, Artificial Sequence
  Synthetic oligonucleotide
gtaagggccttgcagaggggcatctggtcaccagcagctcatccccagcagggccagctcctttgtgggcag

SEQ ID NO: 5379 - DNA, 34 bp, Artificial Sequence
  Synthetic oligonucleotide
tccccatgtgagagcagcagaggcggtcttcaac

SEQ ID NO: 5380 - DNA, 10 bp, Artificial Sequence
  Synthetic oligonucleotide
atcctgccag

SEQ ID NO: 5381 - DNA, 6 bp, Artificial Sequence
  Synthetic oligonucleotide
ccccac

SEQ ID NO: 5382 - DNA, 31 bp, Artificial Sequence
  Synthetic oligonucleotide
acagctacagctttcttgctcccttcagccc

SEQ ID NO: 5383 - DNA, 7 bp, Artificial Sequence
  Synthetic oligonucleotide
ccagccc

SEQ ID NO: 5384 - DNA, 5 bp, Artificial Sequence
  Synthetic oligonucleotide
ctccc

SEQ ID NO: 5385 - DNA, 4 bp, Artificial Sequence
  Synthetic oligonucleotide
ccat

SEQ ID NO: 5386 - DNA, 7 bp, Artificial Sequence
  Synthetic oligonucleotide
ctcccac

SEQ ID NO: 5387 - DNA, 7 bp, Artificial Sequence
  Synthetic oligonucleotide
cctgtac

SEQ ID NO: 5388 - DNA, 6 bp, Artificial Sequence
  Synthetic oligonucleotide
ctcatc

SEQ ID NO: 5389 - DNA, 7 bp, Artificial Sequence
  Synthetic oligonucleotide
ccatgag

SEQ ID NO: 5390 - DNA, 10 bp, Artificial Sequence
  Synthetic oligonucleotide
accctggtgc

SEQ ID NO: 5391 - DNA, 7 bp, Artificial Sequence
  Synthetic oligonucleotide
ctggctc

SEQ ID NO: 5392 - DNA, 10 bp, Artificial Sequence
  Synthetic oligonucleotide
tttcgtcacc

SEQ ID NO: 5393 - DNA, 6 bp, Artificial Sequence
  Synthetic oligonucleotide
cttgga

SEQ ID NO: 5394 - DNA, 6 bp, Artificial Sequence
  Synthetic oligonucleotide
caagac

SEQ ID NO: 5395 - DNA, 29 bp, Artificial Sequence
  Synthetic oligonucleotide
aaaccaagtcggaacagcagataacaatg

SEQ ID NO: 5396 - DNA, 10 bp, Artificial Sequence
  Synthetic oligonucleotide
cagcaaggcc

SEQ ID NO: 5397 - DNA, 11 bp, Artificial Sequence
  Synthetic oligonucleotide
ctgctgcccaa

SEQ ID NO: 5398 - DNA, 7 bp, Artificial Sequence
  Synthetic oligonucleotide
tctccat

SEQ ID NO: 5399 - DNA, 10 bp, Artificial Sequence
  Synthetic oligonucleotide
ctgtcaacag

SEQ ID NO: 5400 - DNA, 22 bp, Artificial Sequence
  Synthetic oligonucleotide
gggcgtgaggtcccaggaagtg

SEQ ID NO: 5401 - DNA, 8 bp, Artificial Sequence
  Synthetic oligonucleotide
gccaaaag

SEQ ID NO: 5402 - DNA, 6 bp, Artificial Sequence
  Synthetic oligonucleotide
ctagac

SEQ ID NO: 5403 - DNA, 7 bp, Artificial Sequence
  Synthetic oligonucleotide
agatccc

SEQ ID NO: 5404 - DNA, 10 bp, Artificial Sequence
  Synthetic oligonucleotide
cgttcctgac

SEQ ID NO: 5405 - DNA, 7 bp, Artificial Sequence
  Synthetic oligonucleotide
atcacag

SEQ ID NO: 5406 - DNA, 16 bp, Artificial Sequence
  Synthetic oligonucleotide
cagcctccaacacaag

SEQ ID NO: 5407 - DNA, 14 bp, Artificial Sequence
  Synthetic oligonucleotide
gctccaagacctag

SEQ ID NO: 5408 - DNA, 13 bp, Artificial Sequence
  Synthetic oligonucleotide
gctcatggacgag

SEQ ID NO: 5409 - DNA, 47 bp, Artificial Sequence
  Synthetic oligonucleotide
atgggaaggcacagggagaagggataaccctacacccagaccccagg

SEQ ID NO: 5410 - DNA, 6 bp, Artificial Sequence
  Synthetic oligonucleotide
ctggac

SEQ ID NO: 5411 - DNA, 85 bp, Artificial Sequence
  Synthetic oligonucleotide
atgctgactgtcctctcccctccagcctttggccttggcttttctagcctatttacctgcaggctgagccactctcttccctttc

SEQ ID NO: 5412 - DNA, 5 bp, Artificial Sequence
  Synthetic oligonucleotide
cccag

SEQ ID NO: 5413 - DNA, 14 bp, Artificial Sequence
  Synthetic oligonucleotide
catcactccccaag

SEQ ID NO: 5414 - DNA, 24 bp, Artificial Sequence
  Synthetic oligonucleotide
gaagagccaatgttttccacccat

SEQ ID NO: 5415 - DNA, 9 bp, Artificial Sequence
  Synthetic oligonucleotide
aatcctttc

SEQ ID NO: 5416 - DNA, 7 bp, Artificial Sequence
  Synthetic oligonucleotide
tgccgac

SEQ ID NO: 5417 - DNA, 769 bp, Artificial Sequence
  Synthetic oligonucleotide
gcagaggccaagtcaggaaagcagctaagggaacgtgtacacacatccatgacgtggatagattcccacagtggcctgtagcccctgtgtcagtcctggaacccagtgctatctatgcctgtgaggaccctgcaccaggtccctgctgctctggcctattagagaaagaaggaaccttgggggtcattcaggccagaagtccacagacagagctcaggccttctctgcccaagctctaccagagagtttctgcttttattcttttgtatttgtttttctcaatgaggtagtgttttaaaatctggttccatgaggagaaggagaaaggtgaaaatcacctgtgccgtcattttacaaaaggaaaagagactctcagaagagaaggggttttccccaaggtcaaacggctcagtattggtatgggaagaccccacatcctcaattccttacacacttttcagagggagggaagaaaataggggattgtgatttggagtgaagggctgagtctgcctgaagagtccccaagcccaaggtgctcctgtgacaccatcccatcgtgggggatgagcatcacataccatttgtgccagcatcttgggagtgagaactggggaaggggtgcagaggggcccacagggcctggccgtgggatttcatggtcacagtcaaacacacacacacacaccagcacctgtactcatagctaatccccacccaaactcctacctgaccctgacagctgtccctgggaatattgtctccttag

SEQ ID NO: 5418 - DNA, 166 bp, Artificial Sequence
  Synthetic oligonucleotide
gccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcag

SEQ ID NO: 5419 - DNA, 198 bp, Artificial Sequence
  Synthetic oligonucleotide
gtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatag

SEQ ID NO: 5420 - DNA, 123 bp, Artificial Sequence
  Synthetic oligonucleotide
tccccagctcagctgtaactcccccggagtcaccccagtcggattccctgggctccacctactccatcaatgggctcctgggcatcgctcagcctggcagcgacaagaggaaaatggatgaca

SEQ ID NO: 5421 - DNA, 176 bp, Artificial Sequence
  Synthetic oligonucleotide
gtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcag

SEQ ID NO: 5422 - DNA, 1109 bp, Artificial Sequence
  Synthetic oligonucleotide
gtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtagga

SEQ ID NO: 5423 - DNA, 2859 bp, Artificial Sequence
  Synthetic oligonucleotide
atgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtgggggaccaggcatggtggctcacacctgtagtcccagcactttgggaggccaaggtggatgggtcacctgaggtcaggagtttgagaccagcctggccaacaaggcaaaatcccatctctactaaaaatataaaaattagccaggcctggtggcgtgcacctgtaatcctagctactcgggaggctgagacaggagaatcgcttgaagctggggggcggaggttgcagtgacccgagattgtgccactgcactccagcctgggtgacagagcgaggctccatctgaaaaaaaaaaaaaaagggcagggggaagtgttcatcagaaacatcatgtggccttattcctggttgctatttcatgaccagacatagctagaagtcatacagctcttgtttccctattttacaaatgcatcaaaaaaaatcaacagaatatgaatatcagtttattgacagaaatcaagaatttggtggcttctgactcttcacgattctgaaataatatctgtgataactctcattgggcatctgctgtcaccaagtattcggtgctaagcacattatgtataagtatacaaaatttcatgtaatgcttacgtcagcctcataaagtagagtctatgattcccatacaggtgagaaaattaaggttcagagcagtcaagtagactaaagctacttggcaggtcattgcagaaccagggctcagagtcgctgaagttctgaagcattgtgctgctctgccccgattcaagttcaattccagctaaaaagcccaataatcactgggaagtttcagtcattgaatacaaaatcaccaaaagatttgactatataggttttctttttcctttttttctaagttacttggattttgaaatagctataggattctgagtagatattttgctgtcaaaacaacacatccataaagcattttaaacttctcttatacgctctagaaattaggtattttgttcaatttcaataagacacaccctggccaggtgcaacggctcatgcctgtaatcccaacactttgggaggtcaagccaggcagatcatgaggtcaggagtttaagactagcctggccaacatggtgaaactcctgtctctactaaagatacaaaaaattagcctggcatggtagcacgcacctgtaatccctgctactcgggaggctgaggcaggggaatcacttgaacccaggaagcagaggttgcagtaagcgaagatcgcaccattgcactccagcttgggcaacaagagcaaaactccatctacaaaaaaaaaaaaaaaaaaaggccctaagcaactccaccctgcctctaagtgggcccccttggaaggcatggaaccagagcaccatttagtcaataattgctgctatgtgctaatggtgccctggtggcctccagaattgactgcagcttccaaaagtgcccagcatgcaaccggaaagtgctgtggatctttgcagaacccagctcgatggaaatcactgaaaacaattgcctttagtggcactgttatgtaactactgagcattccctgaattcagctttgcacatctcacgtagcaggtatgtgacgagtgtgaaggtatgtggggaatgggtgtgttcttttttctgcgctatctgcttccccagtggaaggaggccatggtgaggatgaggtacacttacctttagttaaacaagttcttttcggaaggagtacctaaggtcatagctgtgctcctgggaaggggaggccaggaggcatctaaaatgaggtcttactgatgaagacccccaggtacttgacaaagagtgtttccaacaaaaacaa

SEQ ID NO: 5424 - DNA, 816 bp, Artificial Sequence
  Synthetic oligonucleotide
ctctcaataccattttcaagccgaacttgcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccagg

SEQ ID NO: 5425 - DNA, 121 bp, Artificial Sequence
  Synthetic oligonucleotide
ggcctctacccgctgcccttgctcaacagcaccctggacgacgggaaggccaccctgaccccttccaacacgccactggggcgcaacctctcgactcaccagacctaccccgtggtggcag

SEQ ID NO: 5426 - DNA, 809 bp, Artificial Sequence
  Synthetic oligonucleotide
gtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaag

SEQ ID NO: 5427 - DNA, 4254 bp, Artificial Sequence
  Synthetic oligonucleotide
tgtcactacagggacccaccaccacacctggctaatttttatatttttggtagagacggagtttcaccatgttggccaggctggtctcgaactcctggcctcaggcaatctgcccgccttggcctcccaaagtgttgggattacaggtgtgagtcactgtgcctggtccctccatccatcttttaattcatctgtcttttcagttatctatcatccatctttccatccatccatctttccatcaatccttttatttttccatccatattcattcgtccattcatcttttcatagaactatcctttaatctgtctttccatctatcctttcatcatccattcttccacccatccctcctctcctatatccatcttttcatccccttttcaatctattcctccattaatctatacatctttctatatatacatccttttatctgtccatctttccatccatcttttcacccatccatcctttcatcatcaatccttccatcattcacactttcattcatccttccatccttccatccatttaccactttttcacttaacaaatactggttgaaggtctactgtataggatgctggggatacagcagtgaataagtcagattcctttattcctggagcttataacctaatggtgaagacaaatggacaataaataagtcaatgaatgaacataataatttattgtctgtgaagacaataaaatgggatgatgtaataaagagccacagggagaggagataactactttagattgggctgtcaggggaggcctctctgagaaggtgttcaaagtgaccattcaagtgataaactggggcagaccatccctggaccaaagaacagcaagggcaaaggacctaaggcaggaactagtttagcatggtagcacaaaattgtagtggctgggtcgagttttaaaaggctactctgatttctaggaaaatgaattgtacatagtcaagagagaaagcacaaagaccagttaggggacagttgcagtagttcttgcaagagatgacagtggcttgagttagggaattagcagtgaaggagggaaaaagagaccctgaaaatatattttggttgcaaagccagcaaaccttgctggtagattggctgttgggatgagaaaatagaggaaacaagaatcatttgtaggtttggggcatggatgatggtggcaagtatatatatggcagaccaggaggggaagtgatgtagtagatggcaagtggaaatcaagagttttttgggccgtgttatgattgagatgcctactaaatgtccagttttaataagtcagcaggtacatcatgtgtgtctgaagccaggaaagaatcctgactagagtataaatttcagccattgcacaaagctgtcatttaatgacaagactactagaaaccaagcctggggttcttcaacaatttagagctctaacagagaaggaacagcaaggagaatgagtaggaaagacaactgagttacaaagcaaacagaagactgggcatcacaaacccaaaggcatgagacagggatgagctaaaaggtcaagggaattgaggatatagaagtgaccattggtatgatggagttagagactgtggggacttgaggggatcagagttggcctgataggaagggataagaaggtgaaggcagagaccatggggcagagaaaggcactggtagctagagaggaatgtggggataggaagaggattttttaaagacagaagatagcagaatatgtttgcagggtgaagggagagactgatgaaacagaaaacgggatcattggagcggccaaatccttggaaaggtgagtagggtgggatgcagagcaaagaggcagggttggcctttcatcggggcagagacgtttcatctgctgtgactgcaagcaggtaggcacatctgatgacgggaagatgccacacccaggtgtgtaccacctaccgagctccatcccctgccccaggttccatgtgactgaggtactcggtaaatggtagttaaatacataaataagtgggtgagtgagtgaatgcatgaatgagtgacaaaatgagagggtaaacacatcatgttttccacctctctcccttgtcctctagagctcactgtgtttgccattgggtagggtgtggtaaaaggtgagagggcccttgctgtgtggccagtagagaatcggctgaaacccgggagacctgagttaaacaggaggcagttggcactgggagatgcaagagagagtgccattgtggaaggacggggccagggttctagttctggctttcactgaatatgtgaccttggccaaatgtctttacttccctatgtcacagctgtgttatctgttaaacagatgtttagagtagattatttcttagtttttcatctgttaaatagatgtttcgattagattatttcttaggtttttttttctttgcttttttacttctttacccccttcctttttttacccatgttttttgcttgatttacgttagacttagtctctgcccctaaggaactttcttactgtgttctcagtccgtcattgacttcctagacaaggagaggatccagtagcctttctctgctttaggctgctcctcttcatctctcttcttcctgtataaatgcctacttgtctggcaataaagcagctcccactaaccccaacccaggccttaagactggttggatgactgatttaagcctccattgagctttattttcgcacctgtttaatgggaaaataataaaagcttagatttattgagcactccctgtatatttgaagcatggtgctaagcatttaatacatattttgtcatttaattctcattaaaccaaatgagatagggataattatttggcccattttacagataaggaaaccaaggttcacctgtaagtcactcactcagagaggctaagtgacttgtccaagtttacataaccaggaaatgggaagtaaggatttgactctagacaggtcagctccagagtcagggagtttcgagcaacccctccaaagagtctggggaaggagactcagaaccacatagctcccaatcgtaggtgagtttctgaaaggctgggtggacattcattgagtctcagggttggcaggaatctagctttgtaaatggaattatcgcataagtgaataaagggattatctgcaatttggagtcaagagccctaaggtcgagttctactctgacatttaacaacagtgtgatttgaggcaaactgcttaatcatgctgcactccagtttccttttctataaattggtagtatccatgagtacctcatggggtagtcttgagaataaaagatcataatgtatgggaaagtgctttacaaactttaagctctttaccaagcaccggtagtagctgtggtgatcagtttgactttgtttttgttatgtaagggaattcttaagtaatttcttcggtaaataattcctttggaaaactcaagaatccattaacagaaggaggtgatctgatttactttgtgtaaatttatacgttgagtttgcttaaagcggcagactcaggatggaacaacaaactactccaagtcccaggacacagcttcctgagggtgtgtgccctctggggctctccctcctctcccatccttaaccctcacacctcccctcagccccccatgcacacaaacacacacactcatacctagcgaggctaaaaggttcatatatatggatgtcctctttggcccctaaccccatacccctgctgtggggccctcccagaagagcccttctccagaaggtccaggcagcagaaggagcagttagtccctgggccctacactcacagcacagtttcccagctccaccaaaccctccagctctgggagcttccgcagatcccagaggctcagtttcttcatctggaaaatgggggtagttataacatctaccttctgggcctcctgggagggctgtagtatgtcaagccagtgcctccagtacctacggaaaaggacactgccccaaattttccagatcgatgggttccaaaagggatgacagagggaccttctgagctccattgtccctgccgtggctccaactgtctcccccaccattcctgagcttgcccattgccagccctgcagaccttcccacaccccagccctgcattgatgcccttcacctcacaggcctctcccctgtgtgcctccaacag

SEQ ID NO: 5428 - DNA, 1482 bp, Artificial Sequence
  Synthetic oligonucleotide
gtaagtccctggggctgcccaggcctctgctgggcaggatggatggagtggtggggggcaagggtgggtcaaaggttacctgaaagctgggagtcctcagattatacagagggcctgggagatggtgctgtttgtgatggaagaaggcagcaggagggcagtgtacctggttgtttggggaaagagggcagaagtccagaggcttccaggcattcgtttccctcctgcttctcaagcccatgtcttttaaatctttgttttgtgtaagattcagggctcaggccttgaaggggaggacaagggaggacttgagaaaagcctaagagaggacctcctgcctccacggcttacagtcccacagtgcagacactgacgcagggcacccgccagaatgtaactgccctccttcctgggagccagtttcaagaatgccatcctgttgcccccattaaccatctaagtggctcagaaatactcatgattcagcaccaaacccttaaacagaaatcttttgttccaccacattccccatatttagcctgagatgaagacagtattcagggtcgaggtccagagagtgagcttcagcgagcttccaggcttctcttcacccctctcttgtcctggggtcctgaactgggaagagaagcttttcagcaaagcaaaaccccaccaatggggggacttgagggatcccactagagcctccctgagtggtggccttgggtgtatcagagcaaaccggagccagacagaagcagtgatccaaggatggccaaccccacaggcaccattgcaggctaggaaccatccattccccaagaccccctctcctcccattacctctttgtattccagaaataacttgaaaggtggcagacctgggccctgtttgccagatgagttcaactccaacccagctttccattcaatttagccagaaaagacgagggcaatgagacatgccagggttcaggcaccttcccactgagcctccccaggctgcccatcctgcaggtgtgcagagcctcaccttaagggccgtcaagcccagatcccctttgacccctcagcagtctaatctccctgggtcttaagaaagaagactctctgtcctggcactgtttgggcaaggctagggaggatcccaatgacctctcagtgcacttgattctttggggttccacatgcaattgttttctattgccctctccctattgcaacgagggtgttgaaggtcaaagcagccatagggggaaggggcaagaagccactgttctcattctggccagaaactcaaaggtgaggccagagaaggaggaaatagggctggagaggagttaatcttcgatgatcagataggccagagaaatgaatgattaacttgtgttgtcttaaaggtcagcagatgcagggaaggctatggtgcaattttcctttctgaccagcagtgttgttgttatttttttttaatgtgtccag

SEQ ID NO: 5429 - DNA, 380 bp, Artificial Sequence
  Synthetic oligonucleotide
gttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaag

SEQ ID NO: 5430 - DNA, 133 bp, Artificial Sequence
  Synthetic oligonucleotide
gagagaagaagcaatagccgaggaacttggggggatggcgaatggttcctgcccgggcccaaggggtgcacagggcacctccatggctccattattaacacaactctagcaattatggaccataagcacttcc

SEQ ID NO: 5431 - DNA, 322 bp, Artificial Sequence
  Synthetic oligonucleotide
ctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacaga

SEQ ID NO: 5432 - DNA, 172 bp, Artificial Sequence
  Synthetic oligonucleotide
ggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaag

SEQ ID NO: 5433 - DNA, 3034 bp, Artificial Sequence
  Synthetic oligonucleotide
gcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaccatggtttaaaactcgcctttctttcccggaggtgagctgggcttgccaggagcctctgctcagagcgggtgtttgttgactgtgggatgtgttccccatgtaacaggccttggctagtacccatccaatattctgcccatggtcaaaccatgggtccccttttcgggctcagaaaataaggccatttatgtatcgggcgaaagaaagacaattcgacgtgccccggcatttggggtggtgttgggaggagtcaggctggcacatggggggacgcaatgaagaaaggtgggatggcaaggacagggaggacacgcagggggctttgagggttggccgaggggccactttcacctggggtagggagggcggcttctgtgagtggtcgcaggtgaaggggggttgctttatggtgcaggggagccaggggttctctgggggtggtatgtgtgtttgtaggagaattggggatgaggatgggcccaaaacattgctgaggcattgagagcactgagggcctatcccttccccctggaataatccctttcactgctcatgtagagagaccacctgagcttcccaggcagtttactcttaacttctccctggtccattaccctcactcctcttcatcctcaggttctagcacaggccaggccagcccagggtgctaggagcttgcaggaaattcatgtggaccaaccaactctggcaggtcagtgggtttcttgctgggaaagggggcagctggaaccctgcctggggcccaccagatgaacagaattgctgtgaccccgtaacctctaccacaaagttccaggactagagacagcggaactgggagtcctcacctacaaagccagcccccaggctagttccaacccctccccttgtcacatcatctcttacttctccaatatccttgccatgagttgtgagactaagaaacatgtatcttctgccctctgtgtgccaaacacacactcaaaaacacacactcaaccctggtgacaacttcaggcaagaggagttagtgaaacctactggaagtggaagcaggagcctccaaatagaaacagaaagacagacaggttgaggctgttgctaagatctcccctctcccacctgccctcaccatcctcccacttccaccacccaaaatacacacacctttcccatccataccaacatgaggcttcctggccaggcactgtggctcacgcctgtaatcctagcactttgggaggctgaggcgggtggatcatgaggtcaggagtttgagaccagcctggccaacatggtgaaaccccgtctctactaaaaacacaaaaattagccaggcatgttggcgcatgcctgtaatcccagctactcaagaggctgaggcaggagaatcacttgaaccctggagacggaggttgcagtgagctgagatcgcaccactgcactctagcctgggtgacagagcaaaactctatctcaaaa

SEQ ID NO: 5434 - DNA, 95 bp, Artificial Sequence
  Synthetic oligonucleotide
gggggggaacaaacttcagaaggaggagagacaccgggcccagggcaccctcgcgggcggacccaagcagtgagggcctgcagccggccggccag

SEQ ID NO: 5435 - DNA, 100 bp, Artificial Sequence
  Synthetic oligonucleotide
ggcagcggcaggcgcggcccggacctacgggaggaagccccgagccctcggcgggctgcgagcgactccccggcgatgcctcacaactccatcagatctg

SEQ ID NO: 5436 - DNA, 89 bp, Artificial Sequence
  Synthetic oligonucleotide
aatcatccggaccaaagtgcagcaaccattcaacctccctatggacagctgcgtggccaccaagtccctgagtcccggacacacgctga

SEQ ID NO: 5437 - DNA, 46 bp, Artificial Sequence
  Synthetic oligonucleotide
gtgaggcaagtccatatgcctttaagaaccgagtaggacaatggag

SEQ ID NO: 5438 - DNA, 79 bp, Artificial Sequence
  Synthetic oligonucleotide
atcctcactcacccttcgccataaagcaggaaacccccgaggtgtccagttctagctccaccccttcctctttatctag

SEQ ID NO: 5439 - DNA, 110 bp, Artificial Sequence
  Synthetic oligonucleotide
ctccgcctttttggatctgcagcaagtcggctccggggtcccgcccttcaatgcctttccccatgctgcctccgtgtacgggcagttcacgggccaggccctcctctcag

SEQ ID NO: 5440 - DNA, 102 bp, Artificial Sequence
  Synthetic oligonucleotide
ggcgagagatggtggggcccacgctgcccggatacccaccccacatccccaccagcggacagggcagctatgcctcctctgccatcgcaggcatggtggcag

SEQ ID NO: 5441 - DNA, 56 bp, Artificial Sequence
  Synthetic oligonucleotide
gtaaggagagggccggcaggaaggggagcactgcaaagaggaagtattggagcaag

SEQ ID NO: 5442 - DNA, 87 bp, Artificial Sequence
  Synthetic oligonucleotide
gaagtgaatactctggcaatgcctatggccacaccccctactcctcctacagcgaggcctggcgcttccccaactccagcttgctga

SEQ ID NO: 5443 - DNA, 10 bp, Artificial Sequence
  Synthetic oligonucleotide
cattccacag

SEQ ID NO: 5444 - DNA, 30 bp, Artificial Sequence
  Synthetic oligonucleotide
ggcctgggcccctgggaggtgaggtgtggt

SEQ ID NO: 5445 - DNA, 16 bp, Artificial Sequence
  Synthetic oligonucleotide
gtgcggcttcacccag

SEQ ID NO: 5446 - DNA, 389 bp, Artificial Sequence
  Synthetic oligonucleotide
aggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagggagcgcgggaccaagcggcggcgaaggaggggaagaagagccgcgaccgagagaggccgccgagcgtccccgccctcagagagcagcctc

SEQ ID NO: 5447 - DNA, 152 bp, Artificial Sequence
  Synthetic oligonucleotide
agcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctg

SEQ ID NO: 5448 - DNA, 148 bp, Artificial Sequence
  Synthetic oligonucleotide
agccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccg

SEQ ID NO: 5449 - DNA, 150 bp, Artificial Sequence
  Synthetic oligonucleotide
cctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagca

SEQ ID NO: 5450 - DNA, 9 bp, Artificial Sequence
  Synthetic oligonucleotide
ccgagacag

SEQ ID NO: 5451 - DNA, 70 bp, Artificial Sequence
  Synthetic oligonucleotide
ctggctgagaagatcttctgaaatccaaaatgattgtagggttggcggtgagctgatctccggcctcgag

SEQ ID NO: 5452 - DNA, 48 bp, Artificial Sequence
  Synthetic oligonucleotide
gtggcttcagggggcccacctggttaagggaaatttggcagtgcgagg

SEQ ID NO: 5453 - DNA, 50 bp, Artificial Sequence
  Synthetic oligonucleotide
gcacttgctggattctccaaaagtatctgcagtggctgttccaccaggag

SEQ ID NO: 5454 - DNA, 30 bp, Artificial Sequence
  Synthetic oligonucleotide
gggtcccaccaatcttgtttgcttctgcag

SEQ ID NO: 5455 - DNA, 34 bp, Artificial Sequence
  Synthetic oligonucleotide
gagtgcatccgggcctgcaagcccgacctctcgg

SEQ ID NO: 5456 - DNA, 45 bp, Artificial Sequence
  Synthetic oligonucleotide
ccgagactcccatgttcccgggaaatggcgacgagcagcctctga

SEQ ID NO: 5457 - DNA, 25 bp, Artificial Sequence
  Synthetic oligonucleotide
ccgagaacccccggaagtacgtcat

SEQ ID NO: 5458 - DNA, 12 bp, Artificial Sequence
  Synthetic oligonucleotide
gggccacttccg

SEQ ID NO: 5459 - DNA, 9 bp, Artificial Sequence
  Synthetic oligonucleotide
ctgggaccg

SEQ ID NO: 5460 - DNA, 6 bp, Artificial Sequence
  Synthetic oligonucleotide
attcgg

SEQ ID NO: 5461 - DNA, 21 bp, Artificial Sequence
  Synthetic oligonucleotide
ccgccgcaacagcagcagcag

SEQ ID NO: 5462 - DNA, 19 bp, Artificial Sequence
  Synthetic oligonucleotide
cggcagcagcggcgcaggg

SEQ ID NO: 5463 - DNA, 7 bp, Artificial Sequence
  Synthetic oligonucleotide
cagaagc

SEQ ID NO: 5464 - DNA, 8 bp, Artificial Sequence
  Synthetic oligonucleotide
gcgaggac

SEQ ID NO: 5465 - DNA, 7 bp, Artificial Sequence
  Synthetic oligonucleotide
gtctcag

SEQ ID NO: 5466 - DNA, 30 bp, Artificial Sequence
  Synthetic oligonucleotide
cgggcgaagactgcggcccgctgcctgagg

SEQ ID NO: 5467 - DNA, 6 bp, Artificial Sequence
  Synthetic oligonucleotide
gcggcc

SEQ ID NO: 5468 - DNA, 5 bp, Artificial Sequence
  Synthetic oligonucleotide
ccgag

SEQ ID NO: 5469 - DNA, 4 bp, Artificial Sequence
  Synthetic oligonucleotide
cccc

SEQ ID NO: 5470 - DNA, 4 bp, Artificial Sequence
  Synthetic oligonucleotide
gcag

SEQ ID NO: 5471 - DNA, 5 bp, Artificial Sequence
  Synthetic oligonucleotide
cgatg

SEQ ID NO: 5472 - DNA, 8 bp, Artificial Sequence
  Synthetic oligonucleotide
gtgccaag

SEQ ID NO: 5473 - DNA, 10 bp, Artificial Sequence
  Synthetic oligonucleotide
ccgggcccgc

SEQ ID NO: 5474 - DNA, 5 bp, Artificial Sequence
  Synthetic oligonucleotide
gcgag

SEQ ID NO: 5475 - DNA, 6 bp, Artificial Sequence
  Synthetic oligonucleotide
ggcaag

SEQ ID NO: 5476 - DNA, 12 bp, Artificial Sequence
  Synthetic oligonucleotide
cgctcctactcc

SEQ ID NO: 5477 - DNA, 14 bp, Artificial Sequence
  Synthetic oligonucleotide
atggagcacttccg

SEQ ID NO: 5478 - DNA, 13 bp, Artificial Sequence
  Synthetic oligonucleotide
ctggggcaagccg

SEQ ID NO: 5479 - DNA, 4 bp, Artificial Sequence
  Synthetic oligonucleotide
gtgg

SEQ ID NO: 5480 - DNA, 8 bp, Artificial Sequence
  Synthetic oligonucleotide
gcaagaag

SEQ ID NO: 5481 - DNA, 15 bp, Artificial Sequence
  Synthetic oligonucleotide
cggcgcccagtgaag

SEQ ID NO: 5482 - DNA, 24 bp, Artificial Sequence
  Synthetic oligonucleotide
gtgtaccctaacggcgccgaggac

SEQ ID NO: 5483 - DNA, 39 bp, Artificial Sequence
  Synthetic oligonucleotide
gagtcggccgaggccttccccctggagttcaagagggag

SEQ ID NO: 5484 - DNA, 4 bp, Artificial Sequence
  Synthetic oligonucleotide
ctga

SEQ ID NO: 5485 - DNA, 8 bp, Artificial Sequence
  Synthetic oligonucleotide
ctggccag

SEQ ID NO: 5486 - DNA, 27 bp, Artificial Sequence
  Synthetic oligonucleotide
cgactccgggagggagatggccccgac

SEQ ID NO: 5487 - DNA, 22 bp, Artificial Sequence
  Synthetic oligonucleotide
ggccctgccgatgacggcgcag

SEQ ID NO: 5488 - DNA, 14 bp, Artificial Sequence
  Synthetic oligonucleotide
gggcccaggccgac

SEQ ID NO: 5489 - DNA, 6 bp, Artificial Sequence
  Synthetic oligonucleotide
ctggag

SEQ ID NO: 5490 - DNA, 5 bp, Artificial Sequence
  Synthetic oligonucleotide
cacag

SEQ ID NO: 5491 - DNA, 14 bp, Artificial Sequence
  Synthetic oligonucleotide
cctgctggtggcgg

SEQ ID NO: 5492 - DNA, 11 bp, Artificial Sequence
  Synthetic oligonucleotide
ccgagaagaag

SEQ ID NO: 5493 - DNA, 17 bp, Artificial Sequence
  Synthetic oligonucleotide
gacgagggcccctacag

SEQ ID NO: 5494 - DNA, 15 bp, Artificial Sequence
  Synthetic oligonucleotide
gatggagcacttccg

SEQ ID NO: 5495 - DNA, 9 bp, Artificial Sequence
  Synthetic oligonucleotide
ctggggcag

SEQ ID NO: 5496 - DNA, 13 bp, Artificial Sequence
  Synthetic oligonucleotide
cccgcccaaggac

SEQ ID NO: 5497 - DNA, 11 bp, Artificial Sequence
  Synthetic oligonucleotide
aagcgctacgg

SEQ ID NO: 5498 - DNA, 22 bp, Artificial Sequence
  Synthetic oligonucleotide
cggtttcatgacctccgagaag

SEQ ID NO: 5499 - DNA, 530 bp, Artificial Sequence
  Synthetic oligonucleotide
gagggcgtcagccagggcacagcagctttctcgcccagcgaagcctgtgcgccttcctcccgcgcctgcagacaagcggagcccatgggggccgtgggccccacctatcccgacgtctccacttgatccagaagttgtcccagtccccttggagcatgagctgttgcctggacagctgggctgtcgcccaggttctgccactgtctagctgtgtaaccttgagccagtccctgcccctctctggtcctcagtttccccacctgtaaaatgggggcaccgagaaccctcctccaggacctgcggcggggcggggcggcagggcgggggcctccccgccgctcccgcgcccgcggcttgggctccgcagtgagtggggagcggcgccggggaaggagcgctccgcggtcatgtgacgtccccctccccgaactgcggcggcggcgagcgccggccgcatctgagcagagctgcagcggcggccgcgggcaccagagtgccgagcccaggacgcccccggcccaggcccttgg

SEQ ID NO: 5500 - DNA, 566 bp, Artificial Sequence
  Synthetic oligonucleotide
gtgagcggccccctccctaccataacagaccccagcctgtgcaatgccctcggagtccttgttggggtcatagcacaggcccggtggtggggtcaggaagaacatccactgttctcagggctcattggcctctgtccccgggctccattcccctccctgccaagtcagaggtcaggcccctggggcggcaggcaggaaggacactgagggaaggggcactgaggcaggaggggcactgagggaagctggccaggtggaagtaggagagaaaggcaatgggggtgagatggtaccacttcctccccatatgaggctctcaggaggctcctggccccccctgcacaggtagtggtccctccttcctgagggtgtttgggggaaaacgctatggttggggcactggggaaggttgcctcgcagatgaaacagaacattggccaaaggtgtccctgaatgggcttctggactggcacagggccctgagggctgtggctgagtggggaggcagtgatcaggtccagctggccatgggggccccccattcccttctccatgacctcagcctc

SEQ ID NO: 5501 - DNA, 172 bp, Artificial Sequence
  Synthetic oligonucleotide
gggctcttgacgggctcctgcacccaccagaatgtgcagagaagaggtcccaggtgggagccgagagggggctgagggcagatccccaagagagaagtaattggtgtgagagaggatctcaatttcttcgtgtctaaaatggggaaactgcagcgccacttaccctgcctag

SEQ ID NO: 5502 - DNA, 125 bp, Artificial Sequence
  Synthetic oligonucleotide
cggccgcgttgccaaggtgacccgggcgcgggaaggcggctccggctcgcgcgggccgggccgggcggcggcggcggcaccatgagcggccggaagcgcagcttcaccttcggggcctacggcgg

SEQ ID NO: 5503 - DNA, 387 bp, Artificial Sequence
  Synthetic oligonucleotide
gtagggcgtggcgcggcgcggggcggggcgcgtgcgcgcgtgtgcgtgtgcacgcgtgggggggagcccgtgcggggtgtgctcgcgtttgggcgggtgggcctgggctatgactgctgtgggggctgagcgtttgacctcagtgcgcgcatggctgtcgtgctgtggcgcctgtgtgtgtgtgtttctgtttctgtgtctgtgtgtgttcccattgcgtgtccatgtgcatgtgtggggaggtgagtgcagggtggacattgctgtgtttgtgtctaagcacatgatagtggcgcttatgcatgtgactggggctgcggggctactccgcctgtgtgtgcgcgcgtgtgtgtgcatgcgtgtgtgcgcaactgctcacatgtatag

SEQ ID NO: 5504 - DNA, 300 bp, Artificial Sequence
  Synthetic oligonucleotide
ctatttcacctcttggaaccggcttctcatctgtataatggagatgacatttgtacctcctgggctgtgacgagattacgacacatgcgaagggcccagcattaagtaggtgctcaagaaaagccctctgtctgcaaggtaacccaaccctgtccttgatgccgaggcggggtacccagagcctgggaagatggagaaagtgaggtgggggcgcgctggggagaaccgagtggggggccccctcggggagcccgacgcacccaaagcttctagcgctcgggccggaacgcgcaggcgcgg

SEQ ID NO: 5505 - DNA, 186 bp, Artificial Sequence
  Synthetic oligonucleotide
gtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaag

SEQ ID NO: 5506 - DNA, 793 bp, Artificial Sequence
  Synthetic oligonucleotide
gtatggctggatctgggcacagctcactgagggtgggtgagtaactggaagactgagcatttattaagcaccttctgtgtgccagatactttcccaaggttctctcatttaatcctcacaataaccctgtgaagtccacaatttgcagaagaggagccaccgaaagggcctgtgccttcccccagggtgcacagcagataggagggcctgcgtttaagcctcggtttgtctgccttagaggctggcctcacatctggaacctctgtgatgtttggggaccctcctgagagcaagctgtgccatagtcctcccctggaatgggtgtcttttctaccggccttgcctttttatcccagaggagacctatagagagagaatagccctggcacttcctgctcggatgctggtagctgggctctaggcactgtgacagtgtggggataggggcacgggcttctgccttggatgagccaggggcacctcctggaagaggacagacaggtaaacccttgggtccctgactgaattctggagcagtgtgaggtggtgtggtccaggaaaggtatcctgaaggggcttcagaaatcagggcccccctcctgcttatgggagaggaaactgaggcctaaggtgaggaggagaacttgctcaatgcccacagcaaattggtgggacgtgtcctgttctgggaggatgatgtgggtttacagaggagccgaggagtgagttgggagttagagtggagtaggggtgggcttggcatggcaggactcggggctacactaagctaaaa

SEQ ID NO: 5507 - DNA, 130 bp, Artificial Sequence
  Synthetic oligonucleotide
gttccgaggaggcctggacgtgacccacgggcagacggggaccgaatctgtgtactgcaacttccgcaacaaggagatcatgtttcacgtgtccaccaagctgccatacacggaaggggacgcccagcag

SEQ ID NO: 5508 - DNA, 1472 bp, Artificial Sequence
  Synthetic oligonucleotide
ctgggaattctgctgaagggtggaggattctgggagacagcaagggctgctggtacaaaggctgctaggtcagcaggaagagaagagaggaagaggctctgtcttgactgagggaaagttctcagaagaggtgtgtgaaccatgatcattggagagggacttggcctgtgtgacctaccctgcctgtccctggtttagcttagcattaagagcacggacacttcaaatttcagctctgttacttaccagcttgggcattctgtgagcatcagtttctttatctgttgagtagggtaatggcaacttgcctcatacagttattgttatctgtaaaagagttaggttagtgcaatacaagtttaaaagcaaaatgcaaaaccttgcctgtctgcctcagcaaatgttgtctgaaatgagaagtgtggggagtggagtagttcctggacagggtctggactcactcaggccacagggccccaggtggtagcctttttgccaccgtctcctccacccacaggaggataactgcccatcctccagcttcccggccggctggtcacacctcaccctcaacccaggacaggtcacacagctggagctatgggttggaataagggaattagcccggctgcccaggcctgcccaggaactgaggtgaacagatcgtctttgagaaagaggcttggggactggagacaggacaggtggggtcaatatggatctggggtgtctcctttgaggagggctccgatggtcccacatctggtaggtgctggacggtggacctagattaggtcaaagaatttctcagaagcagcggagtccagagttgagggcatgggtcctggcatgccgggctcacccctgcctcagttggcatgaaatgggcatgattgctagtccccatcttgcagggggatccagtgatagagtgattgtaaagcgctggtcccatagcaagcatttggtgtagattggtctgaaaaaaacaaggaaagagggtgggagggaagaaaagaaagaaggcaggagagctctaagaggccctaacaggaatgaaactgaggtgtcaagagggctctctgtgcacacttttggccatgacccagtgtcttctgcagtccttacgcagccacatgaggacactcagcacagagcagcctgtgtgtcccagagagtgagagaactgaagtggtgtccccaaggccacccggcaagttggtggcagagccaatacctgagctacccttaggccccgtatgtacctgcttctcatgtgacgcacagggaaattgaggcctggccccacctccctctgttgccctgctggccacatgcccaggggaagggatttccagggcttacccagagtggcattgctggggagagaccagatgcctgggctcctgggtttccccaaggggacggcccttaggaatcctgtgcctcctccactgccacccccttcacag

SEQ ID NO: 5509 - DNA, 132 bp, Artificial Sequence
  Synthetic oligonucleotide
cgggtcatccggagccgcagccagtccatggatgccatggggctgagcaacaagaagcccaacaccgtgtccaccagccacagcgggagcttcgcgcccaacaaccccgacctggccaaggcggctggaata

SEQ ID NO: 5510 - DNA, 177 bp, Artificial Sequence
  Synthetic oligonucleotide
gttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctg

SEQ ID NO: 5511 - DNA, 743 bp, Artificial Sequence
  Synthetic oligonucleotide
gtacctgtgccagagccagtgcccctcaccaggggcttctggccctgccttggcccctgggaccctggcccagtccctgccaggatccggtacccaaaggccctacacccagccgcacgtcccccaatatcgccggtctgcatggagcgccatccctctcctctgccctgactcctcctccccgccacgaagtgacctggggtcctaccccttcctgcctccagagaagctgggggcgggcttctggggcctggggcatcccagcacagtgtgtgggaagctgggggagtcttccagctgctgggccagaacctcccccagccaatttggaggttccggggaggggccctagctggcacggggtgggacttgggttgctacactgccctctgaccactgcccttaggctgcagatcccacagagccctggggggcggggagcggtagccattctgaggactcggcctcctcccaccctagccccctcaggatgctgtcctaatcctgggccagtattgacgtgcagtcctgccgtgtgagctcgggagagccccttgccctcctggggactgtttccctttcgtaaactgggaggctgtctctgggaatggatatcttctctcgttctttcttgctcatcaactctgcttcagggcctggggcagcaggatccccagaggggatgtgggggggcactggggctcccaggtaaggtggcactgagttggggcctctccccacag

SEQ ID NO: 5512 - DNA, 124 bp, Artificial Sequence
  Synthetic oligonucleotide
agcggagaccgcagcgcagagagcagaggcgctcaaggacttctcccgctcctcgtccagtgccagcagcttcgccagcgtggtggaggagacggagggtgtggacggagaggacacaggcctg

SEQ ID NO: 5513 - DNA, 304 bp, Artificial Sequence
  Synthetic oligonucleotide
gtaccaggacaaggcagcttccccacaaagcagggctaccttggggtaggagggggacagggctgggcaccagttcccatgccccatgcagtggatgtgatgtgactgcccctgacttggaggacagcgggcaggtcattgtccagcctagggtggctgggtggattggagggctggtttcttccggaagggtctcggaggataatgggggatggcaaggaagaaagttaagggtggggttggagcgcactggtgccgaccgcccacctatgcccccgtctccctggtgcctccccgcggccag

SEQ ID NO: 5514 - DNA, 304 bp, Artificial Sequence
  Synthetic oligonucleotide
gttagacccagcccctcagcttgtgtttggtgggagagggtgggggtgtgtagagggctgagctgattcctccctgttcttctgtcacctctctggggtgggagctatgtatctgggtttgagccccctggtcctcagttgctgggtgacttgggcaggccacggcccttccccgtgacctctgcccttgcattgttggaggatttgatgggagtgtgaaagggacttggcagttgccaggtggggagaagtttcaggggttcccaatgggatggaaagacctggagcctggaattccaagggt

SEQ ID NO: 5515 - DNA, 185 bp, Artificial Sequence
  Synthetic oligonucleotide
aggtcactgaagactgtgattacatgcacctgccttagaaggtaggattttcttcccagggacctcctatcaccctaccctgcttcttgaggtccctggagccccaggtgggctgaggggcagggagccggctgtgcccagtatgcctcctggaccctccagttctgccacaggtctgccgatgc

SEQ ID NO: 5516 - DNA, 151 bp, Artificial Sequence
  Synthetic oligonucleotide
cttgtgtgtctggtcacactttttaggcgtcacgccaaaggccagcctcctggccccaatacccattttggaagcccctgtggccgtgtggatgtcggtaacagttgtataaaataaattctatttatcgctattgtaacaaagagttggg

SEQ ID NO: 5517 - DNA, 83 bp, Artificial Sequence
  Synthetic oligonucleotide
ggtttggtgccagctgcggggcgcctgggcttggggaagaaaccttgtgtacgcacacctgcacacacacacagtctccggag

SEQ ID NO: 5518 - DNA, 84 bp, Artificial Sequence
  Synthetic oligonucleotide
gatctccacagcggtggagaggaggaagggtgaacgccgtggtggagtggtccatgtggacctgctcccctttgctgccaggag

SEQ ID NO: 5519 - DNA, 28 bp, Artificial Sequence
  Synthetic oligonucleotide
gttaatacctctgccaaccgaggccacc

SEQ ID NO: 5520 - DNA, 79 bp, Artificial Sequence
  Synthetic oligonucleotide
ctccctcggacccccattcggaggaagcagacccaagttcgaattctgacattgccactgagcagccgtacaacttttg

SEQ ID NO: 5521 - DNA, 36 bp, Artificial Sequence
  Synthetic oligonucleotide
ggtggacaagtccttcacttctcgccggagtgtgtg

SEQ ID NO: 5522 - DNA, 94 bp, Artificial Sequence
  Synthetic oligonucleotide
gaggagcgatgggcagaaccagcacttccctcaggcactagacctgtcacgagtgaacttagttccctcctatactccttcactctaccctaag

SEQ ID NO: 5523 - DNA, 36 bp, Artificial Sequence
  Synthetic oligonucleotide
aacacagatctatttgagatgattgagaagatgcag

SEQ ID NO: 5524 - DNA, 48 bp, Artificial Sequence
  Synthetic oligonucleotide
ggaagcaggatggatgaacaacgctgctccttcccgccgcccctcaaa

SEQ ID NO: 5525 - DNA, 39 bp, Artificial Sequence
  Synthetic oligonucleotide
acagaggaggactacattccatacccgagcgtgcacgag

SEQ ID NO: 5526 - DNA, 104 bp, Artificial Sequence
  Synthetic oligonucleotide
gagcatttcaattactactcactggacgctgccctcggccaccttgtcttctcactcaagtacgatgtcatcggggaccaagagcacctgcggctgctgctcag

SEQ ID NO: 5527 - DNA, 48 bp, Artificial Sequence
  Synthetic oligonucleotide
gaccaagtgccggacataccatgatgtcatccccatctcctgcctcac

SEQ ID NO: 5528 - DNA, 31 bp, Artificial Sequence
  Synthetic oligonucleotide
cgagttccctaatgttgtccagatggcaaag

SEQ ID NO: 5529 - DNA, 54 bp, Artificial Sequence
  Synthetic oligonucleotide
ttggtgtgtgaagacgtcaatgtggatcggttctatcctgtgctctaccccaag

SEQ ID NO: 5530 - DNA, 53 bp, Artificial Sequence
  Synthetic oligonucleotide
gcttcccggctcatcgtcacctttgacgagcatgtcatcagcaataacttcaa

SEQ ID NO: 5531 - DNA, 31 bp, Artificial Sequence
  Synthetic oligonucleotide
gtttggcgtcatttatcagaagcttgggcag

SEQ ID NO: 5532 - DNA, 26 bp, Artificial Sequence
  Synthetic oligonucleotide
acctccgaggaagaactcttcagcac

SEQ ID NO: 5533 - DNA, 75 bp, Artificial Sequence
  Synthetic oligonucleotide
caatgaggaaagtcccgctttcgtggagttccttgaatttcttggccagaaggtcaaactgcaggactttaaggg

SEQ ID NO: 5534 - DNA, 78 bp, Artificial Sequence
  Synthetic oligonucleotide
ttgcagcggaagcggcacatcgggaacgacatcgtggctgtggtcttccaggatgagaacactcctttcgtgcccgac

SEQ ID NO: 5535 - DNA, 26 bp, Artificial Sequence
  Synthetic oligonucleotide
atgatcgcgtccaacttcctgcatgc

SEQ ID NO: 5536 - DNA, 52 bp, Artificial Sequence
  Synthetic oligonucleotide
ctacgtcgtggtgcaggctgagggcgggggccctgatggccccctctacaag

SEQ ID NO: 5537 - DNA, 72 bp, Artificial Sequence
  Synthetic oligonucleotide
gtctctgtcactgcaagagatgatgtgcccttctttggaccccccctcccggaccccgctgtgttcaggaag

SEQ ID NO: 5538 - DNA, 87 bp, Artificial Sequence
  Synthetic oligonucleotide
gggcctgagttccaggaatttttgctgacaaagctgatcaatgctgaatatgcctgctacaaggcagagaagtttgccaaactggag

SEQ ID NO: 5539 - DNA, 63 bp, Artificial Sequence
  Synthetic oligonucleotide
gagcggacgcgggccgccctcctggagacgctctatgaggaactacacatccacagccagtcc

SEQ ID NO: 5540 - DNA, 75 bp, Artificial Sequence
  Synthetic oligonucleotide
atgatgggcttgggcggcgacgaggacaagatggagaatggcagtgggggcggcggcttctttgagtctttcaag

SEQ ID NO: 5541 - DNA, 78 bp, Artificial Sequence
  Synthetic oligonucleotide
tcattgcttattcctgggaaaagtgcgagtagattcggacgccggggcagtgccataggcataggaaccgtggaagag

SEQ ID NO: 5542 - DNA, 25 bp, Artificial Sequence
  Synthetic oligonucleotide
tcactgattgtccctgggaagagcc

SEQ ID NO: 5543 - DNA, 55 bp, Artificial Sequence
  Synthetic oligonucleotide
ccacgaggaagaagtcgggcccgttcggctcccgccgcagcagcgccattggcat

SEQ ID NO: 5544 - DNA, 30 bp, Artificial Sequence
  Synthetic oligonucleotide
cgagaacatacaggaggtgcaggagaagag

SEQ ID NO: 5545 - DNA, 114 bp, Artificial Sequence
  Synthetic oligonucleotide
ggagagccctccggctggtcagaagaccccagacagcgggcacgtctcacaggagcccaagtcggagaactcatccactcagagctccccagagatgcccacgaccaagaacag

SEQ ID NO: 5546 - DNA, 56 bp, Artificial Sequence
  Synthetic oligonucleotide
ctggcccaggaggggctcggggtggacaccggctaatggggcactgtctgtggcag

SEQ ID NO: 5547 - DNA, 103 bp, Artificial Sequence
  Synthetic oligonucleotide
gagagcgtgtcatcctcaggaacaccccacaagcgggactccttcatctatagcacgtggctggaggacagtgtcagcaccactagtgggggcagctccccag

SEQ ID NO: 5548 - DNA, 31 bp, Artificial Sequence
  Synthetic oligonucleotide
tgaggtggctccctcctgcccccctccccag

SEQ ID NO: 5549 - DNA, 15 bp, Artificial Sequence
  Synthetic oligonucleotide
gcccctctcgatcac

SEQ ID NO: 5550 - DNA, 9 bp, Artificial Sequence
  Synthetic oligonucleotide
cccacccag

SEQ ID NO: 5551 - DNA, 10 bp, Artificial Sequence
  Synthetic oligonucleotide
acgccggcaa

SEQ ID NO: 5552 - DNA, 57 bp, Artificial Sequence
  Synthetic oligonucleotide
gttgggggaccctgcgtgtcccgagatcaagatccagctggaagcatctgagcagca

SEQ ID NO: 5553 - DNA, 13 bp, Artificial Sequence
  Synthetic oligonucleotide
catgccccagctg

SEQ ID NO: 5554 - DNA, 43 bp, Artificial Sequence
  Synthetic oligonucleotide
ggctgttagccgggccaccccctctgaaggtgaaactgagcag

SEQ ID NO: 5555 - DNA, 98 bp, Artificial Sequence
  Synthetic oligonucleotide
atgaggccacagaagcacaaggggaaggtgccgtgtcaagcccaggcagacgagacctctgccctgaagaccaacaccagcccgtgggctgccccctg

SEQ ID NO: 5556 - DNA, 88 bp, Artificial Sequence
  Synthetic oligonucleotide
cctccccaccctccccatggcccacccatctgggctgtctctgcagggcagagccgtccagacctgggatcagggaagctgctggcat

SEQ ID NO: 5557 - DNA, 77 bp, Artificial Sequence
  Synthetic oligonucleotide
cgtccccacccccagcctgggggtctgggctggggcagggattgctcagtggaagcaggactgggggtctggcttgc

SEQ ID NO: 5558 - DNA, 107 bp, Artificial Sequence
  Synthetic oligonucleotide
cccctccctgggcctccatcacccctgagcatccctctggactcagagggaacaaggtgggagagagagtttgagacagctccgtgtggagagcttagcccctggag

SEQ ID NO: 5559 - DNA, 38 bp, Artificial Sequence
  Synthetic oligonucleotide
gcagcacaaggaggatgtgatatgtgggggagtgagca

SEQ ID NO: 5560 - DNA, 111 bp, Artificial Sequence
  Synthetic oligonucleotide
ctgggttgggagccgggtcctggtttccaatttgggttctgctgtgtgactctgggcaagtcactctccctctctgggcatgtctgctacaaatggacaagattatttcag

SEQ ID NO: 5561 - DNA, 71 bp, Artificial Sequence
  Synthetic oligonucleotide
cctgtccactgcctacacatgacagacaagtaaccccctcatgggggatggggacctacctggctcctcag

SEQ ID NO: 5562 - DNA, 117 bp, Artificial Sequence
  Synthetic oligonucleotide
ccagcacccagcttaacccctgccatcccatgctgggccctccaggccaagagtctcagctggccgagagtccaggccttgcctcccccgaccgccatggagggggcagcccggcac

SEQ ID NO: 5563 - DNA, 14 bp, Artificial Sequence
  Synthetic oligonucleotide
agctgctgggagcc

SEQ ID NO: 5564 - DNA, 355 bp, Artificial Sequence
  Synthetic oligonucleotide
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggcc

SEQ ID NO: 5565 - DNA, 148 bp, Artificial Sequence
  Synthetic oligonucleotide
cccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggg

SEQ ID NO: 5566 - DNA, 125 bp, Artificial Sequence
  Synthetic oligonucleotide
acatgaatgaacacagctctagaagtcacagtatcttcctgataaatattaaacaagagaatgtagagactgaaaaaaaactcagtgggaaactttatttggttgatttggctgggagcgaaaag

SEQ ID NO: 5567 - DNA, 147 bp, Artificial Sequence
  Synthetic oligonucleotide
ggtttgacttagcctgtggcagaggcagctgcacacatgtgggagggatatgaacttctgagaaaagagaaaatcccatgttgtacccgactctaataggccaggaacgagctttgccattggaatgtggcagtcctgcctctgcag

SEQ ID NO: 5568 - DNA, 125 bp, Artificial Sequence
  Synthetic oligonucleotide
gctgattgtccccatgaaggccagccttgaagcttggtcagtctccctaactgtatgattgatccccacttattgcactacatcactgagttcccgtatgccaagttatggccacttacatccac

SEQ ID NO: 5569 - DNA, 149 bp, Artificial Sequence
  Synthetic oligonucleotide
aaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagag

SEQ ID NO: 5570 - DNA, 149 bp, Artificial Sequence
  Synthetic oligonucleotide
agctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatg

SEQ ID NO: 5571 - DNA, 167 bp, Artificial Sequence
  Synthetic oligonucleotide
attttctagcagcacacgtgtttggaaagctactagaataattgaataattcagcacctgaggctggtggatgattctttgcaatttggcaggaatgggagagtcgggagcagtagttggcaaggtggggagtagccatatgaagttttatttcgggaatcctccag

SEQ ID NO: 5572 - DNA, 176 bp, Artificial Sequence
  Synthetic oligonucleotide
gagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaag

SEQ ID NO: 5573 - DNA, 504 bp, Artificial Sequence
  Synthetic oligonucleotide
gtaaagaatgcaatatatttttttttccacaaagttcttctattactctttgttgttgatgtttgttccaggaatttaattggcatagaagcttttcataattacagaatcatgtggaaatttcttggtagatgtcccttcactgcctcttacaagctgattatcactgaatttagaaaataaatgtctgactttcaaaaacccctgatgttttgagattgagtagccagtggctacagttcgttctggaagggcagagacctttggttgggtgatcaagcaaggatgatccttttttatttttatttttttgagacagggtctctctgttgtccaggctggaatgcagtggtgcaatcatggctcactgcaacctccagagctcaaatgatcttcccgcctaagactctcaagtagctaagactacaagaatgtgccaccatacctagctaattttttaatattttgagacagagtttctctatgttggtcagggtgatcttg

SEQ ID NO: 5574 - DNA, 207 bp, Artificial Sequence
  Synthetic oligonucleotide
cttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacg

SEQ ID NO: 5575 - DNA, 147 bp, Artificial Sequence
  Synthetic oligonucleotide
actacattgacaaccacacagagagagctgagccagctacaagagcttagcaaccaccagaagaaaagggcaactgagatcctgaatttgctgttgaaagatctgggggagataggtggaattattggcaccaatgatgtgaaaact

SEQ ID NO: 5576 - DNA, 189 bp, Artificial Sequence
  Synthetic oligonucleotide
ttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccag

SEQ ID NO: 5577 - DNA, 340 bp, Artificial Sequence
  Synthetic oligonucleotide
gtgagtcggcccagggcaccaggggtgtgggggtggtcatgcctcggtcctcttggggaagcctggaaggatgtggctcttagtcgagggccctgctcaccttgccctgtgggcactgccctggtgacacagcaggctgggcgggctgcttccaaggtctgttctccgatctggagctgagcctcctggagccctggcatggcaggtggcaggcgggcccagctgcctctcctagtccccgagggccagggtcacataggtgattccgctggatggacgcatgccccagtagatgggggggagcatctgtaatgaaagcaccaaaaaaaaaaaaaaaaaa

SEQ ID NO: 5578 - DNA, 217 bp, Artificial Sequence
  Synthetic oligonucleotide
ctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcg

SEQ ID NO: 5579 - DNA, 1320 bp, Artificial Sequence
  Synthetic oligonucleotide
atatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgtt

SEQ ID NO: 5580 - DNA, 933 bp, Artificial Sequence
  Synthetic oligonucleotide
gtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccacttt

SEQ ID NO: 5581 - DNA, 1247 bp, Artificial Sequence
  Synthetic oligonucleotide
tttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttggctggtc

SEQ ID NO: 5582 - DNA, 18 bp, Artificial Sequence
  Synthetic oligonucleotide
ccccacccatccccgtgc

SEQ ID NO: 5583 - DNA, 91 bp, Artificial Sequence
  Synthetic oligonucleotide
caagggaagccatatgtcttcgacagagtgctacctcccaacacgacccaagagcaggtttacaatgcatgtgcgaagcaaattgtcaaag

SEQ ID NO: 5584 - DNA, 74 bp, Artificial Sequence
  Synthetic oligonucleotide
atgtccttgaaggttataacgggacgatttttgcgtatgggcagacttcatcaggaaaaacccacaccatggag

SEQ ID NO: 5585 - DNA, 105 bp, Artificial Sequence
  Synthetic oligonucleotide
gggaagctgcatgacccccagctcatggggatcatcccacgaattgcccatgatatctttgaccatatctactccatggatgagaacctggagtttcacataaag

SEQ ID NO: 5586 - DNA, 49 bp, Artificial Sequence
  Synthetic oligonucleotide
gtttcctattttgagatctacttggacaaaataagggacttacttgatg

SEQ ID NO: 5587 - DNA, 56 bp, Artificial Sequence
  Synthetic oligonucleotide
tatccaagaccaacttggctgttcatgaagataaaaacagagtcccgtatgtaaag

SEQ ID NO: 5588 - DNA, 88 bp, Artificial Sequence
  Synthetic oligonucleotide
gggtgcactgagcggtttgtgtcgagccctgaggaagtcatggatgtaatagatgaaggcaaagcaaaccgacacgtggctgtgacaa

SEQ ID NO: 5589 - DNA, 105 bp, Artificial Sequence
  Synthetic oligonucleotide
gtcagcaaaactggtgccgagggagctgttcttgacgaagctaaaaatatcaataagtctttgtctgctcttggaaatgtgatctctgctttggcagaagggaca

SEQ ID NO: 5590 - DNA, 61 bp, Artificial Sequence
  Synthetic oligonucleotide
ggtatgaaatcaaggcttaggtgcaaagccattggataccatacctgagaccacacagcca

SEQ ID NO: 5591 - DNA, 69 bp, Artificial Sequence
  Synthetic oligonucleotide
gatgatgaaattaaccagcagagccagctggctgaaaagctgaagcaacagatgttggatcaggatgag

SEQ ID NO: 5592 - DNA, 118 bp, Artificial Sequence
  Synthetic oligonucleotide
cacgaagccaagatcaagtctctgacagactacatgcagaacatggaacagaagaggaggcagctagaagagtcccaggactcgctcagcgaagagctggcaaagctccgagcccagg

SEQ ID NO: 5593 - DNA, 77 bp, Artificial Sequence
  Synthetic oligonucleotide
aaaaaatgcacgaagtcagcttccaggataaggagaaggaacatctgacgcggttgcaggatgctgaagaaatgaag

SEQ ID NO: 5594 - DNA, 110 bp, Artificial Sequence
  Synthetic oligonucleotide
aaggcgctggagcagcagatggagagccaccgggaagctcaccagaagcagctgtccagactccgagacgaaattgaggagaagcagaaaatcattgatgagattcggga

SEQ ID NO: 5595 - DNA, 102 bp, Artificial Sequence
  Synthetic oligonucleotide
tttgaatcagaaactgcaactggaacaggagaagcttagttctgattataacaagctgaaaatagaggaccaagagagagaaatgaagctggaaaagctctt

SEQ ID NO: 5596 - DNA, 61 bp, Artificial Sequence
  Synthetic oligonucleotide
attgctcaacgataaaagggaacaagccagagaagacctcaaagggctggaggagacagtg

SEQ ID NO: 5597 - DNA, 72 bp, Artificial Sequence
  Synthetic oligonucleotide
tctagagaattgcagacactgcacaaccttcggaaactctttgtccaggatctgaccacccgagttaaaaaa

SEQ ID NO: 5598 - DNA, 105 bp, Artificial Sequence
  Synthetic oligonucleotide
agtgtggagttggacaacgatgatggagggggcagtgctgcccagaagcagaaaatttccttcttggagaataacctggagcagctcaccaaagttcacaagcag

SEQ ID NO: 5599 - DNA, 114 bp, Artificial Sequence
  Synthetic oligonucleotide
ccaagcccatccgccccggacactacccggcctcatctccaacggccgtccatgccattcgagggggaggaggcagctcttcaaattccactcactaccagaaataaatacaaa

SEQ ID NO: 5600 - DNA, 118 bp, Artificial Sequence
  Synthetic oligonucleotide
gtgtgcccaagatgagtgagctggcactgtgccctgaagctttcaccactgtaatgaaatatatgccaggggagactttgggcttttctcatgactgtgtgggtcgaaggtagctcaa

SEQ ID NO: 5601 - DNA, 6 bp, Artificial Sequence
  Synthetic oligonucleotide
gtgtgt

SEQ ID NO: 5602 - DNA, 6 bp, Artificial Sequence
  Synthetic oligonucleotide
gtgtgt

SEQ ID NO: 5603 - DNA, 55 bp, Artificial Sequence
  Synthetic oligonucleotide
ctaaaaaagccacatatgtgcaattttcaggtttttagactattgctccctgtac

SEQ ID NO: 5604 - DNA, 258 bp, Artificial Sequence
  Synthetic oligonucleotide
tcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacag

SEQ ID NO: 5605 - DNA, 179 bp, Artificial Sequence
  Synthetic oligonucleotide
ggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccag

SEQ ID NO: 5606 - DNA, 176 bp, Artificial Sequence
  Synthetic oligonucleotide
gggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataag

SEQ ID NO: 5607 - DNA, 440 bp, Artificial Sequence
  Synthetic oligonucleotide
gtcagctccgcccgcccgcccgtcctggggagggccacaagcgggtaaaaccggtccagctaaagcccctgctggggctcccctggatcccagctctcaccttcgccctagttctgagcctcactcttctcatcagcaaaacgggtatcacaaggtcacctccctcaagggatccttttggggattaaataagagaatgcgcgtagtaggtactccaagagggtggaccctacggtccaccattccgtactgcagatctttgggaccaaaaatgagtgcagttctgaatttgggaatgttcgaaaaataccacagtgtcctaagcactttgtgctgtcagctgtcactcccagcgggtctggggctgccaccctactccagacagtccagtgcatgtctgttagtgcgtgcaataaataaaggctagaagtagtcttcca

SEQ ID NO: 5608 - DNA, 374 bp, Artificial Sequence
  Synthetic oligonucleotide
tatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccag

SEQ ID NO: 5609 - DNA, 333 bp, Artificial Sequence
  Synthetic oligonucleotide
cccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccag

SEQ ID NO: 5610 - DNA, 263 bp, Artificial Sequence
  Synthetic oligonucleotide
gaggacgcttcctggccaaagccccaagcctttggtgagaagccaattcccacttgacagaaggcgtccatccattcatctcactggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggatt

SEQ ID NO: 5611 - DNA, 788 bp, Artificial Sequence
  Synthetic oligonucleotide
tcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgttta

SEQ ID NO: 5612 - DNA, 201 bp, Artificial Sequence
  Synthetic oligonucleotide
gggaaccagaaaagtcccctggtctgtcccttctttggggagcagggcctcgacagctccagctcccttgacctacctttcctccccgcaccccgcccccaccttgtgcccctgtgtccagccccccagggggcctgtgtctgtgtctgtgcctgtgtctgtgatggggagccgcctcgcacccctgttgtctgcttgtct

SEQ ID NO: 5613 - DNA, 536 bp, Artificial Sequence
  Synthetic oligonucleotide
ctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttag

SEQ ID NO: 5614 - DNA, 276 bp, Artificial Sequence
  Synthetic oligonucleotide
gggaacacaatgactatcattactgatgcagacctggctgtggagagcagctaatgtgtggcccagagagcctgtctgtgtggagcacgtagtgcacagaatacgtgagagttgctctggcaggggcaggatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaa

SEQ ID NO: 5615 - DNA, 330 bp, Artificial Sequence
  Synthetic oligonucleotide
gggagagaacccccagatgagaaaataggaaggagcaatcatttgtagatgggtgaaaaaagaatgaggttcaagggagcgtgcaccaggtgaggtgagcgtgtgtgctctcagggaagggcccaggctcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtccagacaccatcccag

SEQ ID NO: 5616 - DNA, 343 bp, Artificial Sequence
  Synthetic oligonucleotide
ggggacagctggtgggcaaagcagccaccccacagccttgtggctagagtacagtggggtggaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatc

SEQ ID NO: 5617 - DNA, 147 bp, Artificial Sequence
  Synthetic oligonucleotide
ctgcccgcgtgggggatcccctttcccacatccgtgctgtgtcattgttgctctgcttcctttcaatgtgtcagtgcctggggggaggggaggagcaccccctcagcccccctgaacctgaccaaaagccatggctgttgctccccc

SEQ ID NO: 5618 - DNA, 80 bp, Artificial Sequence
  Synthetic oligonucleotide
gaaggtgtggtccctgccatgctatctgctctgctcagcgactgaaggtgcccgcatcccagctctgccaggaagcaaag

SEQ ID NO: 5619 - DNA, 69 bp, Artificial Sequence
  Synthetic oligonucleotide
agagagagagagagagagagagagagagatttgaatttcccatctggaaggggagcggtagaacgtcag

SEQ ID NO: 5620 - DNA, 119 bp, Artificial Sequence
  Synthetic oligonucleotide
gttgtcacatcttcccaagccaggccagccaggagcgctgcatgcaaattctgccgtgggctaaggcacgctaaccagagccggcggcatggacttcgtcatgaagcaggcccttggag

SEQ ID NO: 5621 - DNA, 60 bp, Artificial Sequence
  Synthetic oligonucleotide
ggtatccacctgcaccccactcccaagtagcttgaaaaagggaggacagtctttccccag

SEQ ID NO: 5622 - DNA, 6 bp, Artificial Sequence
  Synthetic oligonucleotide
gtgtgt

SEQ ID NO: 5623 - DNA, 8 bp, Artificial Sequence
  Synthetic oligonucleotide
ctttgtgt

SEQ ID NO: 5624 - DNA, 8 bp, Artificial Sequence
  Synthetic oligonucleotide
ctgttatc

SEQ ID NO: 5625 - DNA, 6 bp, Artificial Sequence
  Synthetic oligonucleotide
gcccag

SEQ ID NO: 5626 - DNA, 67 bp, Artificial Sequence
  Synthetic oligonucleotide
gtgtgtgtaagagagagagagagaacagggaggatacagaagtattgcagcccagatcccctatcag

SEQ ID NO: 5627 - DNA, 70 bp, Artificial Sequence
  Synthetic oligonucleotide
ctttgtatgatgcaaatgctgaaatgtacaaaatcaaccatgacaacaaagaaaaagaccttgtacagca

SEQ ID NO: 5628 - DNA, 343 bp, Artificial Sequence
  Synthetic oligonucleotide
gaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcagacgccctcagatctacgctctctgatgcaacgccggaatcgcggaaaccgccggtgcacgttggagtcataagacggcgtcggtgttgcagtctgtgtccttggaggtgaccagggccactgcaggcatggtgctag

SEQ ID NO: 5629 - DNA, 172 bp, Artificial Sequence
  Synthetic oligonucleotide
tcggccttccaaagtgctgggattacaggcgtgagccaccgcgcccagccaaccagtgtgcttcttaaatgttcaaccagtcactgtgccaatatcagcttttggctgttggggtctttatgcttagattgttccagttgccttatacttgagatgttattttgattttaag

SEQ ID NO: 5630 - DNA, 159 bp, Artificial Sequence
  Synthetic oligonucleotide
gctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagag

SEQ ID NO: 5631 - DNA, 165 bp, Artificial Sequence
  Synthetic oligonucleotide
aatacagtgaaatgcgtttggttctgagctgcagtagaggggctgtctccagttttgcaccatttgtgatttttaacacttactaccgtctgcctaatattagtgaaaaagttggtgtgtataaatgacattattgaacaaatgttgtttatttcaatttgacag

SEQ ID NO: 5632 - DNA, 196 bp, Artificial Sequence
  Synthetic oligonucleotide
tgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaa

SEQ ID NO: 5633 - DNA, 196 bp, Artificial Sequence
  Synthetic oligonucleotide
gttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctgg

SEQ ID NO: 5634 - DNA, 382 bp, Artificial Sequence
  Synthetic oligonucleotide
gtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcag

SEQ ID NO: 5635 - DNA, 454 bp, Artificial Sequence
  Synthetic oligonucleotide
ctcgggagcccgaggtgagattataggcatgagccacactgtgcccagcctatgaattcagtttatgatgtataatgacaaaattttgtattgagaacttgcatacttttagtgttcctaatacttagtaaaatagtgtagttgagtggaaagaacacaagctgtggagtcagaaggccccccaggtgggcttagctcccacctcttttcttttgtgctgtgtaactgaagaccagtgaccccctctcaggttccttatctctaccttggaagtaacatctgttttgcaagattgtggggactaccggagctaaatgcctaggcaggacaatggcagggggagcctgtcagcatttactatacattgctactgttccacacacatgaggacactagagtggatacatgaccctcaggctttggggggtatgaaataagacctgttttcccctaa

SEQ ID NO: 5636 - DNA, 871 bp, Artificial Sequence
  Synthetic oligonucleotide
tagagctctcccactcatctcctgttacctctcggcgtctccgaggacgcaagggctccagagcctggagcttgaaaacaggtgtgctaggtgattgctacctccatttcacttcttcattaaacaaatctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgcttcagagctagacaaaacgggccactgagaaaaatactgagctgtgtctagtcacagcttggggctggcttttgtttttgtttttttttttattttccttcatcaaacagcatggtgcttgagatatgctgtaaagggagacagatcttttatgcttcattaaataactgagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcag

SEQ ID NO: 5637 - DNA, 132 bp, Artificial Sequence
  Synthetic oligonucleotide
gatatcccagaagctcctgagagactgatgacagacaccattaatgaaccaatcttgctgtgtcgatttcctgtggagatcaagtccttctacatgcagcgatgtcctgaggattcccgtcttactgaatct

SEQ ID NO: 5638 - DNA, 325 bp, Artificial Sequence
  Synthetic oligonucleotide
gtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaag

SEQ ID NO: 5639 - DNA, 1518 bp, Artificial Sequence
  Synthetic oligonucleotide
gtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtacctggaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactctttgctggcttaattttcttaaagctaaacatctctttgtcacattcgttcatgcttttgcaattattttatcttttttatgatgtatatatgtgaaattaagtactactaaatttagtagatattgctaacgttatatggtaatgagaacgaatgattttttaacgttagatatgtgggtcatggttaaatcttttttgtaatcttttttgtgttactgttggacacattagattttatcctgttttgcaattaagtgaaatgacaggtcaaaatgaggcatttaggctgggtgcagtggctcacacctgtaatccctccactttgggagaccaaggcgggcagatcatctgaagtcaggagttcaagaccagcctgagcaacatggtaaaaccccatctctacaaaaataaaaaagttagccaggcatgatggcaggtgcctgtaatcccagctacccagga

SEQ ID NO: 5640 - DNA, 638 bp, Artificial Sequence
  Synthetic oligonucleotide
atggagtttcgctcatgtcgcccaggctggagtgcaacagtgcaatcttggcctaccacaacctccgcctcccaggttcaagcgattctcctgtctcagcctcctcagtagctggattacaggcatgtgccaccatgcccggctaattttgtatttttagtggagaccggtttctctgtgttgctcaggctggcctcaaactcccgacctcaggtgatctgcccgcctcagcctcccaaagtgctgggattacaggcatgagccacggcacccagccacaatgggcacatttagtcatgcagtataagtgaagaatggaggtcactcagaagacacagtttttcattacctacaaagttctacatcaatccgccctggttcccctacctctcgccgcccccctactcaagccatgtggcctccctgctgttctttgacagccttgttatggggctgagttgtgttcccccaacagacatgttgacatcctagcccccaggtacctgtaaacatgaacttatttggaaacaggggtctttgcagacgcagtcaggttaagatgaggttattagagtaggcctttaatccaaaatgactggcgtccttccaagaggagaagacaggctgtgactgtggag

SEQ ID NO: 5641 - DNA, 83 bp, Artificial Sequence
  Synthetic oligonucleotide
cagagctgtacgtctctgaccgagagggaagcgatgccacgggagatggaaccaaggagaaaccatttaaaacaggtctaaag

SEQ ID NO: 5642 - DNA, 47 bp, Artificial Sequence
  Synthetic oligonucleotide
tattgtacaatgttcaagaactgtcttttctctcctccctacccaag

SEQ ID NO: 5643 - DNA, 81 bp, Artificial Sequence
  Synthetic oligonucleotide
gcagaagatagtttacgaagagaaaagaacctggaagaagcaaagaagattaccattaaaaatgatccaagtctcccagag

SEQ ID NO: 5644 - DNA, 9 bp, Artificial Sequence
  Synthetic oligonucleotide
ccaaaatgt

SEQ ID NO: 5645 - DNA, 45 bp, Artificial Sequence
  Synthetic oligonucleotide
gtgaagattggtgcgttagaaggatatagaggccaaagagtaaag

SEQ ID NO: 5646 - DNA, 34 bp, Artificial Sequence
  Synthetic oligonucleotide
gtgtttggctgggtccacaggctgcgcaggcaag

SEQ ID NO: 5647 - DNA, 71 bp, Artificial Sequence
  Synthetic oligonucleotide
gaaagaatttaatgtttctggtgttgcgagatggtacaggttatcttcagtgtgtcttggcggatgagttg

SEQ ID NO: 5648 - DNA, 92 bp, Artificial Sequence
  Synthetic oligonucleotide
gtaaatattttctcttatttatgcctgaaaattagatgttttcagtagattcctttattgttttgtatacatttatttaaaacatttattat

SEQ ID NO: 5649 - DNA, 29 bp, Artificial Sequence
  Synthetic oligonucleotide
tgtcagtgctacaatggagttctcttgtc

SEQ ID NO: 5650 - DNA, 58 bp, Artificial Sequence
  Synthetic oligonucleotide
cacggagagcagtgttgcagtgtatggaatgctaaatcttaccccaaagggcaagcag

SEQ ID NO: 5651 - DNA, 26 bp, Artificial Sequence
  Synthetic oligonucleotide
gctccaggtggccatgagctgagttg

SEQ ID NO: 5652 - DNA, 110 bp, Artificial Sequence
  Synthetic oligonucleotide
gtaagtatgcattcgtcagcttttgcaaagaatatgttttttgccgttttgaaacttgaatagtggtgctcacgatagcattgatttattccttctttgcatttgaacag

SEQ ID NO: 5653 - DNA, 4 bp, Artificial Sequence
  Synthetic oligonucleotide
ctga

SEQ ID NO: 5654 - DNA, 17 bp, Artificial Sequence
  Synthetic oligonucleotide
gtacactcacgtggaag

SEQ ID NO: 5655 - DNA, 9 bp, Artificial Sequence
  Synthetic oligonucleotide
ctgagtgtc

SEQ ID NO: 5656 - DNA, 110 bp, Artificial Sequence
  Synthetic oligonucleotide
ctttcctgacttttgacgacctcctgaaccggttggaggacttggtttgtgatgtggtagatcgaatattgaagtcacctgcagggagcatagtgcatgagctcaacccg

SEQ ID NO: 5657 - DNA, 114 bp, Artificial Sequence
  Synthetic oligonucleotide
aactttcagccccccaaacggcctttcaaacggatgaactattcagatgctatcgtttggctaaaagaacatgatgtaaagaaagaagatggaactttctatgaatttggagaa

SEQ ID NO: 5658 - DNA, 51 bp, Artificial Sequence
  Synthetic oligonucleotide
ctaaatcttatgcagaaccccgctgtgtaaagcagatgcaagctgagagac

SEQ ID NO: 5659 - DNA, 21 bp, Artificial Sequence
  Synthetic oligonucleotide
gtcgacgtgttgatgcccaat

SEQ ID NO: 5660 - DNA, 32 bp, Artificial Sequence
  Synthetic oligonucleotide
gttggtgagattgtgggaggctcaatgcgtat

SEQ ID NO: 5661 - DNA, 79 bp, Artificial Sequence
  Synthetic oligonucleotide
ctttgatagtgaagaaatactggcaggttataaaagggaagggattgaccccactccctattactggtatacggatcag

SEQ ID NO: 5662 - DNA, 74 bp, Artificial Sequence
  Synthetic oligonucleotide
agaaaatacggtacatgtccccatggaggatatggcttgggcttggaacgattcttaacgtggattctgaatag

SEQ ID NO: 5663 - DNA, 291 bp, Artificial Sequence
  Synthetic oligonucleotide
ccttgggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccg

SEQ ID NO: 5664 - DNA, 480 bp, Artificial Sequence
  Synthetic oligonucleotide
gtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatataggactccgtggcaaactgctagttgttcgtgcaagtagtagttggcaaactgcttgtactactgagacgggcaagtgcgggaataattacaataaagg

SEQ ID NO: 5665 - DNA, 146 bp, Artificial Sequence
  Synthetic oligonucleotide
ttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaag

SEQ ID NO: 5666 - DNA, 180 bp, Artificial Sequence
  Synthetic oligonucleotide
gaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctgg

SEQ ID NO: 5667 - DNA, 142 bp, Artificial Sequence
  Synthetic oligonucleotide
agaccttttaatcaaagtgaagtttggggaaagcattgaggacttgcacacctgccgtctcttaattaaacaggacattcctgcaggactttatgtggatccgtatgagttggcttcattacgagagagaaacataacagag

SEQ ID NO: 5668 - DNA, 214 bp, Artificial Sequence
  Synthetic oligonucleotide
gcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaag

SEQ ID NO: 5669 - DNA, 219 bp, Artificial Sequence
  Synthetic oligonucleotide
gtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaacatg

SEQ ID NO: 5670 - DNA, 2541 bp, Artificial Sequence
  Synthetic oligonucleotide
gtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactccagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgagaaaactttgatataactcttcttgcttagataaatggttgcagatgacatcacttttagtataacagaacatttctggttttgtttgtattatcttgtaaacatggccaacatggtgaaaccccatctctactaaaaatacaaaaaattagccgggagtggtggcatgcggctgtaatcccagctactcgggaggccgaggcaggagaatcacttgaacccgggaggcagaggttgcagtgagccgagatcgtaccactgcaccccagcctgggcgacagagtgagactccgtcac

SEQ ID NO: 5671 - DNA, 529 bp, Artificial Sequence
  Synthetic oligonucleotide
acggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtgg

SEQ ID NO: 5672 - DNA, 64 bp, Artificial Sequence
  Synthetic oligonucleotide
gcataagggccatgtgttctgaaattattttgaggcaagaagttttgaaagatggtttccacag

SEQ ID NO: 5673 - DNA, 117 bp, Artificial Sequence
  Synthetic oligonucleotide
gagaagacttcatggcggcggctatggttgccttctgataattgaaggatccctagtggaataaggaacgaatttattgcagacattgtaagcaagaacaactggtaaatgttatag

SEQ ID NO: 5674 - DNA, 101 bp, Artificial Sequence
  Synthetic oligonucleotide
agttcccgattttgaaatgctgggctcactcagaagtggcagccccttgtgctttggagaatgaggatatctgccaatggaacaagatgaagtataaatca

SEQ ID NO: 5675 - DNA, 139 bp, Artificial Sequence
  Synthetic oligonucleotide
ctgggctgagtttgcagggctgctcccctcacccaaccccttcgagtcctccgcgggctccgccccacccggcccgtgggggaggttccgtcccgccgccttcgcccgcgcgctgcactcgcggacgatctctgctcgc

SEQ ID NO: 5676 - DNA, 154 bp, Artificial Sequence
  Synthetic oligonucleotide
gtgacccagcaccacctaatccccccaaaccaaagccagatccaaatcccaactgacctggtttcactgataagagcctctaaccctacggggtggtctctatgttgtttacctggcagtgatgtccgtgtcatctgagaagaggagatttcag

SEQ ID NO: 5677 - DNA, 403 bp, Artificial Sequence
  Synthetic oligonucleotide
gcaccctgggaccatcctggctggaaggcatagtgacattgctggcctgagctgaagtgccgattaaaataaattgaaagctgaattaccttatgaacagctgctttacccaggaacaaatgtggagaggaactccttgaaactgtgttctcaagtagaccacttttgagaaattatacatttatcataacatctcaagtcctgctctacatagaatgaccattattatcaagaaaagttctccattccctgtaattcataaggcaatgcaggcctaaccagaaaacaggaactgcgacaaccttgcatcagacacattcgatctctctattcatagttgcattctctttttttttgtttacaaagccaatcaccaataactcggaaaacaaaaacaaaaaaa

SEQ ID NO: 5678 - DNA, 261 bp, Artificial Sequence
  Synthetic oligonucleotide
cgccccttctgtgcgcgcgtggaggccggggcggggcgggcgcagccggcgctgagcttgcagggccgctcccctcacccgcccccttcgagtccccgggcttcgccccacccggcccgtgggggagtatctgtcctgccgccttcgcccacgccctgcactccgggaccgtccctgcgcgctctgggcgcaccatggcccgcggggctgcgctggcgctgctgctcttcggcctgctgggtgttctggtcgccgccccgg

SEQ ID NO: 5679 - DNA, 599 bp, Artificial Sequence
  Synthetic oligonucleotide
ggatgccagcaaccattcctccatcttagttgggttttcaaaatcattcttcatactagaagacaagatctgaggccatggtgaactgtcacatcagttgcggagcacatatgggttgctagagccatgttttagacaccctctagcctaaatctgatcacagtcatctgtccccttctcttagggtctacctttccaaagttgttagggacctgggaggagaggatgatgggatggggagtcaacaggagaaaatcatgtgcaggcagaattggaatttcaacttggtccaggcaacacaattcatttataaattactttatttctctctctctctccccactgcctctcctctgagagcttctctcctagctttttatctgtctctgtctctctgttttttcctctttttatctgagagaatagtgatgtaaaaatggtcaggaattcactttttctaatgagatcctggtcaagctgatattcagaaaagtatttaggaatgtggggccgtggtgtgtttttgatctgttcacgaggtcattccttcctcgtttctctctggaatttggtattaactgctctttcccctcttttag

SEQ ID NO: 5680 - DNA, 624 bp, Artificial Sequence
  Synthetic oligonucleotide
gtgagcagagaacccagcccaggcctgcggagcgtcctgaccgtaatcgttttatctgctaagacatagccttaaagcaaacccttccatctgccgctcccctcgccctgctggcaaattcccaccacgatgggattctcaatcacatggcggattctctgccttcagttccatatgcttttgcctttctggatgcacagaagctcattatagcaaatcatatttctgcataagagcttcagaaaatgaagagaaatgcagatattttcttttaaacatgaatctaacagaaacagggcagtgacttccatgttttaatgagttttgtccctaagtccatccctgccaagggaacaaactggggcccagggtggccaccctcttccctgcagtgtcctaggttaagctcactcacgtcctaaggatttgaccttccaggtcatgcatggatttttaaatcttcaacgtttttggccgttgacttgcatttctcactgcacttcctatgaagcagttcttaactctttctgtgatcagtgttccaaacaggtacacaccttggttcctagaaaaacaaaattcatacgttgaggaatcacctaaacatctcctgatcttcacact

SEQ ID NO: 5681 - DNA, 319 bp, Artificial Sequence
  Synthetic oligonucleotide
aaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtattttgaggagtgggttatctgttgcactgagcctctctgtgtattttcttcttcttttcag

SEQ ID NO: 5682 - DNA, 223 bp, Artificial Sequence
  Synthetic oligonucleotide
ctgttcacggcggattctttgttttaatcttgcgatgtgctttgcttgttgctgggcggatgatgtttactaacgatgaattttacatccaaagggggataggcacttggacccccattctccaaggcccgggggggcggtttcccatgggatgtgaaaggctggccattattaagtccctgtaactcaaatgtcaaccccaccgaggcacccccccgtcccc

SEQ ID NO: 5683 - DNA, 685 bp, Artificial Sequence
  Synthetic oligonucleotide
cagaatcttggctgtttacaaatcacgtgtccatcgagcacgtctgaaacccctggtagccccgacttctttttaattaaaataaggtaagcccttcaatttgtttcttcaatatttctttcatttgtagggatatttgtttttcatatcagactaataaaaagaaattagaaaccaaaaattattttttttttacttaaatattttgccgtgggtggatgttaaagaaggccgtggtaatttacaggatgggttccaagttctcttcttctggggctttaaggcagatttccagcctaaatgctagctctttatttccaaaatgtccttgttgggctcttttcctttcccgtgtcctgccacatcgggatgggtactcttctgcacccagatactcccagccagatactctcctccatccagatactctgtttccagatactctccctgcagctagttatccccttgagtccagatgctgcctgcttccagatactcctctgtatccagatactcctctaaatccaggtactccctacatccagatactgtacttcctaagatgtacaagatgtaccgcattttcccaacactgaagacttgaccacagcttaagtgggttggttaaatacattatggcccagattgcaatggatcttctgccttgttaaaaagaatgaatgag

SEQ ID NO: 5684 - DNA, 11 bp, Artificial Sequence
  Synthetic oligonucleotide
cttgggcgcgc

SEQ ID NO: 5685 - DNA, 67 bp, Artificial Sequence
  Synthetic oligonucleotide
cgtggcgcgcggggccgtgctggcgctgcggctcctcggcctgctccgccgtctggtggccgccccg

SEQ ID NO: 5686 - DNA, 43 bp, Artificial Sequence
  Synthetic oligonucleotide
ggctgactttgacttagcgatgcctttcctgatggaggaaaca

SEQ ID NO: 5687 - DNA, 69 bp, Artificial Sequence
  Synthetic oligonucleotide
gtgacccagcaccacctaatgcccccaaaccaaagccagatccaaaccccaaccgacctggtttcactg

SEQ ID NO: 5688 - DNA, 45 bp, Artificial Sequence
  Synthetic oligonucleotide
gggctgactttgacttagcagatgcctttcgtgatggaggaaata

SEQ ID NO: 5689 - DNA, 69 bp, Artificial Sequence
  Synthetic oligonucleotide
acgacccagcacctcttaattcacccaagctgaagccaaatgcgaaccctgagcagcctggattcattg

SEQ ID NO: 5690 - DNA, 45 bp, Artificial Sequence
  Synthetic oligonucleotide
gggatgactttgacttagcagatgccttacatgacaaaggaaact

SEQ ID NO: 5691 - DNA, 69 bp, Artificial Sequence
  Synthetic oligonucleotide
acgagccagcaccactgaacccacccaaaccaaagccaaatccaaaccccaagcagcctgattccaccg

SEQ ID NO: 5692 - DNA, 46 bp, Artificial Sequence
  Synthetic oligonucleotide
gggatgactttgatttcacagatgtttcttcatggtgaacgaaaca

SEQ ID NO: 5693 - DNA, 33 bp, Artificial Sequence
  Synthetic oligonucleotide
atggtggtttcgatttatccgatgcccttcctg

SEQ ID NO: 5694 - DNA, 48 bp, Artificial Sequence
  Synthetic oligonucleotide
acaatgaaaacaagaaacccactgcaatccccaagaaacccagtgctg

SEQ ID NO: 5695 - DNA, 45 bp, Artificial Sequence
  Synthetic oligonucleotide
gggatgactttgacttaggagatgctgttgttgatggagaaaatg

SEQ ID NO: 5696 - DNA, 69 bp, Artificial Sequence
  Synthetic oligonucleotide
acgacccacgaccaccgaacccacccaaaccgatgccaaatccaaaccccaaccaccctagttcctccg

SEQ ID NO: 5697 - DNA, 48 bp, Artificial Sequence
  Synthetic oligonucleotide
gtagcttttcagatgctgaccttgcggatggcgtttcaggtggagaag

SEQ ID NO: 5698 - DNA, 34 bp, Artificial Sequence
  Synthetic oligonucleotide
gaaaaggaggcagtgatggtggaggcagccacag

SEQ ID NO: 5699 - DNA, 17 bp, Artificial Sequence
  Synthetic oligonucleotide
gaaagaaggggaagagg

SEQ ID NO: 5700 - DNA, 83 bp, Artificial Sequence
  Synthetic oligonucleotide
ccgacgccccaggcgtgatccccgggattgtgggggctgtcgtggtcgccgtggctggagccatctctagcttcattgcttac

SEQ ID NO: 5701 - DNA, 31 bp, Artificial Sequence
  Synthetic oligonucleotide
cagaaaaagaagctatgcttcaaagaaaatg

SEQ ID NO: 5702 - DNA, 51 bp, Artificial Sequence
  Synthetic oligonucleotide
gtcagctggcaggctctttgggaccttgtattcggatccgccgtgaagctg

SEQ ID NO: 5703 - DNA, 4 bp, Artificial Sequence
  Synthetic oligonucleotide
ggaa

SEQ ID NO: 5704 - DNA, 18 bp, Artificial Sequence
  Synthetic oligonucleotide
atggctgaagacctaggg

SEQ ID NO: 5705 - DNA, 32 bp, Artificial Sequence
  Synthetic oligonucleotide
cagaacaaggggaggtggacatggagagccac

SEQ ID NO: 5706 - DNA, 25 bp, Artificial Sequence
  Synthetic oligonucleotide
cggaatgccaacgcagagccagctg

SEQ ID NO: 5707 - DNA, 26 bp, Artificial Sequence
  Synthetic oligonucleotide
ttcagcgtactcttttagagaaatag

SEQ ID NO: 5708 - DNA, 66 bp, Artificial Sequence
  Synthetic oligonucleotide
aagattgtcggcagaaacagcccaggcgttggcagcagggttagaacagctgcctgaggctcctcc

SEQ ID NO: 5709 - DNA, 38 bp, Artificial Sequence
  Synthetic oligonucleotide
ctgaaggacacctgcctgagagcagagatggaggcctt

SEQ ID NO: 5710 - DNA, 128 bp, Artificial Sequence
  Synthetic oligonucleotide
attttcaaacaccgcattccccttaaacctcccaggctcccatcactcccagcaaagagccagcccgctactttatggagacaggagagactgtcagacagttcctgctgctgcccaggtgcatctga

SEQ ID NO: 5711 - DNA, 177 bp, Artificial Sequence
  Synthetic oligonucleotide
ggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccg

SEQ ID NO: 5712 - DNA, 597 bp, Artificial Sequence
  Synthetic oligonucleotide
tgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcag

SEQ ID NO: 5713 - DNA, 483 bp, Artificial Sequence
  Synthetic oligonucleotide
gcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagctaacccatggttatggcgagtgacccgacgtgatctggggggcaggctgcagaggactcatgacag

SEQ ID NO: 5714 - DNA, 443 bp, Artificial Sequence
  Synthetic oligonucleotide
gctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccag

SEQ ID NO: 5715 - DNA, 528 bp, Artificial Sequence
  Synthetic oligonucleotide
ctgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacag

SEQ ID NO: 5716 - DNA, 1146 bp, Artificial Sequence
  Synthetic oligonucleotide
gtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatg

SEQ ID NO: 5717 - DNA, 128 bp, Artificial Sequence
  Synthetic oligonucleotide
gtggtccgtactgagaagaacagtttgaacaaccgattcttaccctggaatgaaattgagacagaggccatcctgtccattgatgacgatgctcacctccgccatgacgaaatcatgtttgggttccg

SEQ ID NO: 5718 - DNA, 145 bp, Artificial Sequence
  Synthetic oligonucleotide
ggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaag

SEQ ID NO: 5719 - DNA, 412 bp, Artificial Sequence
  Synthetic oligonucleotide
gtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgag

SEQ ID NO: 5720 - DNA, 245 bp, Artificial Sequence
  Synthetic oligonucleotide
cttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcag

SEQ ID NO: 5721 - DNA, 617 bp, Artificial Sequence
  Synthetic oligonucleotide
ctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttat

SEQ ID NO: 5722 - DNA, 238 bp, Artificial Sequence
  Synthetic oligonucleotide
ccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctag

SEQ ID NO: 5723 - DNA, 128 bp, Artificial Sequence
  Synthetic oligonucleotide
tgtagagcaagccagtgtccttcgaggaacccacccggctggccgggaagttttacagcaaggcgcctgccttgggataattccttggtgaaattcaccttccccccgcctctgtctggagccccatc

SEQ ID NO: 5724 - DNA, 242 bp, Artificial Sequence
  Synthetic oligonucleotide
ctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgac

SEQ ID NO: 5725 - DNA, 156 bp, Artificial Sequence
  Synthetic oligonucleotide
gtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatac

SEQ ID NO: 5726 - DNA, 730 bp, Artificial Sequence
  Synthetic oligonucleotide
cctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttggg

SEQ ID NO: 5727 - DNA, 188 bp, Artificial Sequence
  Synthetic oligonucleotide
ctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagcagc

SEQ ID NO: 5728 - DNA, 49 bp, Artificial Sequence
  Synthetic oligonucleotide
ggctgcagtggccgccgctggagaccgcgggacctggcgctgcagcgag

SEQ ID NO: 5729 - DNA, 94 bp, Artificial Sequence
  Synthetic oligonucleotide
gagagcaagccctggaggttcactctttcaagaagtcgtgtgctgaggtgtaatgctacacaagtcagaggaaggaagggtcctgaaacacatg

SEQ ID NO: 5730 - DNA, 24 bp, Artificial Sequence
  Synthetic oligonucleotide
cccaagctgtccctgcccatccga

SEQ ID NO: 5731 - DNA, 36 bp, Artificial Sequence
  Synthetic oligonucleotide
tattatgcctacctgtattcttatgtgatgccccag

SEQ ID NO: 5732 - DNA, 93 bp, Artificial Sequence
  Synthetic oligonucleotide
gccatccgggacatggtggatgaatacatcaactgtgaggacattgccatgaacttccttgtctcccacatcactcggaagccccccatcaag

SEQ ID NO: 5733 - DNA, 92 bp, Artificial Sequence
  Synthetic oligonucleotide
gtgacctcacggtggacattccgatgcccaggatgccctcaggccctgtctcatgatgactcccacttccacgagcggcacaagtgcatcaa

SEQ ID NO: 5734 - DNA, 54 bp, Artificial Sequence
  Synthetic oligonucleotide
caggaggagtggaaggaaaccgctgcctttatcttgaagtcagccacactgggc

SEQ ID NO: 5735 - DNA, 41 bp, Artificial Sequence
  Synthetic oligonucleotide
ctgtgttatctgtggtttttggacccctaatgtcagcttgg

SEQ ID NO: 5736 - DNA, 84 bp, Artificial Sequence
  Synthetic oligonucleotide
gttctcctctgacctgcctgtaccacgtgggtcctcttcaagtactgttttgaagctgggctcttttgtgtagctcccacccac

SEQ ID NO: 5737 - DNA, 107 bp, Artificial Sequence
  Synthetic oligonucleotide
ctgtagggctagctcggcttaagggaactctccccattggcaaaccggacccggccgccgccaggactgtgtttccaaaggttccccgcccccaaccccagcatcag

SEQ ID NO: 5738 - DNA, 86 bp, Artificial Sequence
  Synthetic oligonucleotide
ctgtcttaccataacaccgtcccagggctctgcaggccactgtgagcgctggctccctgggcagtgctcctccgtgtggactgtgc

SEQ ID NO: 5739 - DNA, 28 bp, Artificial Sequence
  Synthetic oligonucleotide
ctcaggccagggctcaccagctggggtc

SEQ ID NO: 5740 - DNA, 123 bp, Artificial Sequence
  Synthetic oligonucleotide
caagtcctccagcgccgactccactcccagccccaccagcagcctctctagcgaagacaagcagcacctggccgtagagctggccgacaccaaggccaggctgcggcgcgtcaggcaggagct

SEQ ID NO: 5741 - DNA, 371 bp, Artificial Sequence
  Synthetic oligonucleotide
ggtgcccctccttccctccaatctggtgagcctgttctcccaggtttcctgcagctgatggatgtcacctgtggagcctggctgtggggtggtacagctgccgctggggtctccttacctgccccacacacagggagggagacctgagtggcggatggacatagtttaagggccggtgttgcaaacttatgaaaagaaaagaattttgagtcagtaacatttttgcaggccccataagcagatcgcctccccaccgcccaaatcccgagtcctttccttttcccacaggttttaggaagtggcagcctgctcccagggctgcttgttgaggaagctgcctcccacactctttctccttactgcctctgcag

SEQ ID NO: 5742 - DNA, 159 bp, Artificial Sequence
  Synthetic oligonucleotide
aacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggag

SEQ ID NO: 5743 - DNA, 1208 bp, Artificial Sequence
  Synthetic oligonucleotide
gtagggagccttgctgtgaggcccctggatggggctgctggaaattcctgagaagcacattcagactgacctgtccttgggggcttggaggagcggagccacagctgtttcagcagatgcttccccggcacctcagcctgcctgggcttcccagggcccccgtcttgctcctcttcatctcccagtcagcaggggagggtaaggagtgtaattgattgatgtaaggcagtgattcagggtttctcctgcccccacctcatggcattatgatcaccttctatccgtgtgcgtcttttaaaagacttcttgcaatttctgtggctaatttgctaggactatttcctcatctgtgggaataacgggcaaccgggtgcagcggctcacgcctatattcccagcactttgggagaccaagggtgggaggatcgcttgaggccaggagtttgagatcagcctgggcaacatagcaagactctgtctctacaaaaaataaaaaaatttagccaggcatagtgccacgtgcctgcagtcccagctactcaggaggctgaggcaggaggattgcttgaacctgggatgtcaaggctgcaatgcattgagctatgattgcactgctgcactccagcctaggtggcagagaggaaccctgtccctaaaaataaaataggaattattgttatggctctatgaggtttcaaagatgtaactggtgttgggcaagccccatagccatcagctagtggaggctactctatctttattttaaatcttatcaaggttctgggaaaaatgtaggtgaaagggtcaaggctacatggagacccagacccaggtgaggtctctgatgctttgaccactcaccctgacaacctcatgtcagtagcagcttccgggaccctcttttctgaggatttaggaatttttcccattgcctattccaaggggggctggaagtggttagaaaacgtgagctgagtgaaatcagaatactggcacacattgagtggacttgttcaaggctaagaaataatcccaacgtctctcctaccagccagaaggcctcttaggccaccgaaggcagagcaccgtattgccctctccctgccgtggagctgtcgggcttgccggggaaggctgtgagcccaggatctctacgtgttctgtgctgcagccggggccctggaggctctggaagctctgagtgactg

SEQ ID NO: 5744 - DNA, 147 bp, Artificial Sequence
  Synthetic oligonucleotide
gagctgagagaagataatatcattttaattgaaaccaaggccatgctggaggaacagctgactgctgctcgggcccggggcgataaagtccatgagctggaaaaggagaacctgcagctgaaatccaagcttcacgacctggaattg

SEQ ID NO: 5745 - DNA, 145 bp, Artificial Sequence
  Synthetic oligonucleotide
gaccgggacacagataagaaacgaattgaggagctgctggaagaaaacatggtccttgagattgcacagaagcagagcatgaacgaatctgcccaccttggctgggagctggagcagctgtccaagaacgcagacttgtcagacg

SEQ ID NO: 5746 - DNA, 185 bp, Artificial Sequence
  Synthetic oligonucleotide
cctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaag

SEQ ID NO: 5747 - DNA, 138 bp, Artificial Sequence
  Synthetic oligonucleotide
attgaaaagttacaaacccagctggagagagaaaagcagagcaaccaagatctggagaccctcagtgaggagctgatcagagagaaggagcagctgcagagtgacatggagaccctgaaggctgacaaagccaggcag

SEQ ID NO: 5748 - DNA, 492 bp, Artificial Sequence
  Synthetic oligonucleotide
atcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcacc

SEQ ID NO: 5749 - DNA, 126 bp, Artificial Sequence
  Synthetic oligonucleotide
agcaccaagctggcacagatggagagggagaaccagcagctggagcgtgagaaggaggagctgaggaagaacgtggatctgctcaaggcgctgggcaagaagtcagagcgcctggagctcagctac

SEQ ID NO: 5750 - DNA, 453 bp, Artificial Sequence
  Synthetic oligonucleotide
cagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggag

SEQ ID NO: 5751 - DNA, 128 bp, Artificial Sequence
  Synthetic oligonucleotide
gacctggtgctcgagaagctgaagagccagcagctcagcagtgagctggacaagctgagccaggaactggagaaggtcggcctcaacagggagctgctgttgcaggaggacgacagcggcagtgacac

SEQ ID NO: 5752 - DNA, 142 bp, Artificial Sequence
  Synthetic oligonucleotide
aaaatacaagattttggagggcagaaatgaatcagcattaaaaacaacactagccatgaaagaagaaaagattgtgctcttagaagcacagatggaagagaaagcgagcctaaatcgccagttagagagtgagctgcagatg

SEQ ID NO: 5753 - DNA, 189 bp, Artificial Sequence
  Synthetic oligonucleotide
ctgaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaat

SEQ ID NO: 5754 - DNA, 162 bp, Artificial Sequence
  Synthetic oligonucleotide
aatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcag

SEQ ID NO: 5755 - DNA, 144 bp, Artificial Sequence
  Synthetic oligonucleotide
gtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctg

SEQ ID NO: 5756 - DNA, 128 bp, Artificial Sequence
  Synthetic oligonucleotide
gaccacgagcacctgggcacgctgcacgagcggcaatcggccgagtacgaggccctcatccgccagcacagctgcctaaagacactgcatcggaatctggagctggagcacaaggagctcggggagag

SEQ ID NO: 5757 - DNA, 144 bp, Artificial Sequence
  Synthetic oligonucleotide
gcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacag

SEQ ID NO: 5758 - DNA, 187 bp, Artificial Sequence
  Synthetic oligonucleotide
ggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgag

SEQ ID NO: 5759 - DNA, 146 bp, Artificial Sequence
  Synthetic oligonucleotide
ctgctctcccgtctcaaggggaacttggaggaagaaaatcatcacctcctgagccagatccagctgttgagccagcagaaccagatgcttctggagcagaacatggagaacaaggagcagtaccatgaggcgcatactcaatacat

SEQ ID NO: 5760 - DNA, 1056 bp, Artificial Sequence
  Synthetic oligonucleotide
tgaagtcaaaatcacttcaaatcccttgaggtctctctgggaatccagaaccacagaatttccgaacctcagtctgtttttggtttttgtgtgtgtgcttattgttttgttttgttttgttttgttttgagacggagtctcgctgtgacatccaggttggagtgcaatggcacagtctcagctcactgcaacctccgcttcccaggttgaagccatcctcctgcctcaccctcccgagtagctgggattacaggcatgtgccaccacgcccagctaatttttgtatttttagtagagatggggtttcaccatgttggccaggctggtctcgaactcctgacctcaagttgatccacccacctcggcctcccaaagtgctggggttacaggcgtgagccaccatgcctggcccagaacctcagtctgaatcttctgtttgacacagaaattgaagccaagatgagaaactggagtgataatataaatagatgctgtttcgtttcagagacggggtgagagcacaggcagggttctcttcatgtcacaccaggatgccctcggtgtccagctcgctgtgatgttattgcttactctttaaatgcactgatttttaatcaaacagcctgctctcctctgccctctccacctcacccagattactcagtgccagggaggagtcaagggaatgccagcttatttcactgattattaactttagcagaaaatgagattcatggaaatggctttttgacagaaaaattgccaactaaattaagcacggcatcacttccttcatcctgggagactagagtggatttctgtcacaatgcacatggctctaccatccccagccctgtgccaaactgagaattaagttctagctcctgagccccaaatatgattaccatggtcatgagcgtcattgtcctgaaccccacgtgagtggcctagcttcccagactggggaagaacatcccagcccatgttagggaaccagggacccactgggggtgtgtgggagggctggctatgtcctaaacatctacttctaaccag

SEQ ID NO: 5761 - DNA, 225 bp, Artificial Sequence
  Synthetic oligonucleotide
gaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgg

SEQ ID NO: 5762 - DNA, 278 bp, Artificial Sequence
  Synthetic oligonucleotide
gtaggggcggccgtcctggccgtggtcgggtgaggaagggggtgtcctgaagggtcccgcaccggtggctgtgcacacgtgtgcaggaacgtgccaggggtgggtgactgcatgtgcgccttcgcttagatgtgttacgagccaagtagaaattcagcgtggcgaccgttttgtcccataatgcttttgttactttattttatattttattttaatttttttgagatggagtttcactcttgttgcccaggctagagtgcagcctggctgcctcccag

SEQ ID NO: 5763 - DNA, 1172 bp, Artificial Sequence
  Synthetic oligonucleotide
gttcaagtgattctcctgcctcagcctcctacgtagctgggattataggcgcccaccaccacgcctggctaattttttgtatttttagtagagacggggtttcaccatgttggccaggctggtctcgaactcctaacgtcaagtgatccacccgcctcagcctcccaaactgttggattacaggcgtgagctgccacgcccaaccacttttgttgttttagaacaaaaggtatcattcatcatgtagccgggcagatatctcaatatccaaagctgacattcgtgcaggtaccatagagacaagcgacatagcttattttgggctgcctcgtatgtgccagatttgtagaaagctgctttgtgcagggagatcccaggtgcactcaacacgttctccatgtatataagacctcccgaaagccttgggtggtttatctgttaccactttgaaaggtgggttaggacttcttcagcctgatctggccttgtgtcccaccagccacaggacacactgtgccttttccctaagggctgtcctttggagtttgccagaggttctgaaacaagaacaggatttctcatcatgtatgctgtatttcatcaactctcaggagccatgaaagctgcacagttactttatataccacgaggcaatcaaacggtacagggccaccacttcgaatttttcttacgctcttgttgaaagagcttttctaaataagaattcgatttttgtacacacacgtaaaaggaaaataggaccaagatgagttggttatgaccatgtcagttttgtcaccgtggccacctggccagtggtgactgagacatcactgaaattgcctcctaatttccaagacgttaaaggtgtcttagaatcgattagacacagcatttaccttacacattgttaaattttcagctttacctttaaatatcattttggggagattatttatcccaggcctgcatcccaagtcatttaaatttttacaaaggacactaggactttctgaagacccagcctatgcctgagacccatggggtcttggaggcggaggatataacactgaagaccagcgacaggctaccctctgagtgtggtgtgtgcacaagcctttcagggggcacattcacaagtacctgttgtgtccccttcagatgcaaaaaaa

SEQ ID NO: 5764 - DNA, 175 bp, Artificial Sequence
  Synthetic oligonucleotide
cacctccgcgcaaaaagagtccctttttgaaaagcaaaaacaaggacaaagacaagtctccaacgacccacccagctctctctaaacgcctgcggttctggtcttcctccgacatcccatcctctcctaacgagcctctctctttctccgacattggagatttctaatccctttc

SEQ ID NO: 5765 - DNA, 266 bp, Artificial Sequence
  Synthetic oligonucleotide
ctttatcatgtgtctgtattgtgtaccctccttcatttccgaaattcaaacaaacaaaaaaagccagcgtctaaaaggccagatggccgatagcggacccctcctcctgcccccaatttcaagcttaaagtagccagcgtggattctgatttcaaaatagaagatgagttgtcacactccctggaccatttcttcagcacaacacagttttaggggagcctcaggatatacgtgcacatgtccttgggccaggatgtccgtactaa

SEQ ID NO: 5766 - DNA, 189 bp, Artificial Sequence
  Synthetic oligonucleotide
gccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaag

SEQ ID NO: 5767 - DNA, 147 bp, Artificial Sequence
  Synthetic oligonucleotide
ggggctgagcgtgtagcttctacttacatacctccagtggtggggaattcgctacctcccaagcatcacagttctggaagcaccgacctctcctcttcatgccttcaagcacccttccaggctggccaggaagttccggtggcccag

SEQ ID NO: 5768 - DNA, 672 bp, Artificial Sequence
  Synthetic oligonucleotide
tgttgtggccaggtgggcaggtgccctcagcaccataaaccttgatttttttcctttggggcagatgtaaatttgaggcaaatgacacaaagaagctgaagaatagcaaatgtccaggagaagggagtgcccccttccttcccaggcccctggcacctgctccctgtgggtcccctgacgtgacaccttcaggtgcgtgcccttacatgtgcgcacacatggccctgaacggtcctcatctctcttcccgtggcctcggcctcggctgtccacatgtgttccagaaagctctgtgcagtaatagaggagggccccccgcaacctcaacctctggttcacccagcacagccttttttttgtctgccctctatactggcgttctgtgtgagatttcctttgtgaagttgtttgaagctgcagccccaggcctcataaatgtagataagcagagtatcatctgttgatggctgcttgtgctgtgcccagcactccgttggtgaagtgaggcttcctcactggagcgcagagggagtcccagagctcctccttcctgagggcgttgggcttagctttggcatgggattgttttgctgcatcgtttttcttagatggctcatctgggatatacctggtcattggctttttaattttaacactgccatttcctttcag

SEQ ID NO: 5769 - DNA, 290 bp, Artificial Sequence
  Synthetic oligonucleotide
gctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccat

SEQ ID NO: 5770 - DNA, 300 bp, Artificial Sequence
  Synthetic oligonucleotide
gacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccg

SEQ ID NO: 5771 - DNA, 139 bp, Artificial Sequence
  Synthetic oligonucleotide
gtgcccccagcttcccatgcacctgccagccgcagtgcctccttgagccgggccttcagcctggcctcagctgaccttctccgggccagcgggccagaggcctgcaaacaggagtcccctcagaagctgggggctcctg

SEQ ID NO: 5772 - DNA, 205 bp, Artificial Sequence
  Synthetic oligonucleotide
aggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatca

SEQ ID NO: 5773 - DNA, 782 bp, Artificial Sequence
  Synthetic oligonucleotide
gtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccaccccggccgggccctggaggactgcagtcgagggagcgtctcaaagagcagtccggcctccccggagcccggcggggatccgcagaccgtgtggtatgagtacggctgtgtgtgactgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattcggatgcaatgacaaactgacttcccccaaagcagacactactccagtatgtcccagtagaacactcatttgcaatgtgttgagctccgttaagcacacacacactcacacaacaggctcacgaggctcaggcctggcgggtcagaaagcccactccctctcc

SEQ ID NO: 5774 - DNA, 137 bp, Artificial Sequence
  Synthetic oligonucleotide
caaggccactggatcccaggagaagcccagactggcgatactacaaaggtctccagggcctggcagaccccagagtcaggcctgctgttaaaaagtgagagtgctgctgttccattcctggggtcccaagcacttcc

SEQ ID NO: 5775 - DNA, 730 bp, Artificial Sequence
  Synthetic oligonucleotide
ctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaatcttatctgctgctttgtgtctttggtcagattcctgacaatttagtttcctgttgtaaaggtgcttttcctggggtgaactaaacctattgattttttttttttaagatttttttttccttttgatttaatatactgagaaagaaatgggagacttttgaatgttaacaagatccattttaggagtgtttggggttgtgtattaaatagccattcattctggaactcaaggacaggactgtaataaaatggaatggaaccgaa

SEQ ID NO: 5776 - DNA, 82 bp, Artificial Sequence
  Synthetic oligonucleotide
ggaggataagacagagcagcttgtggacaccagacatgaggtggaccagctggtgctggaactgcagaaagttaagcaggag

SEQ ID NO: 5777 - DNA, 6 bp, Artificial Sequence
  Synthetic oligonucleotide
ctgcag

SEQ ID NO: 5778 - DNA, 90 bp, Artificial Sequence
  Synthetic oligonucleotide
agacaaattaaatgccttacgaagacataaggaaaagctggaagaaaaaatcatggatcaatacaagttctatgatcctcctccaaagaa

SEQ ID NO: 5779 - DNA, 14 bp, Artificial Sequence
  Synthetic oligonucleotide
gtctgtggggaaag

SEQ ID NO: 5780 - DNA, 69 bp, Artificial Sequence
  Synthetic oligonucleotide
gctataactcagatgacaacctctgtgagccatccctggagtttgaggtccccaaccacaggcagtacg

SEQ ID NO: 5781 - DNA, 21 bp, Artificial Sequence
  Synthetic oligonucleotide
tgtcgcggccaagtagcttag

SEQ ID NO: 5782 - DNA, 48 bp, Artificial Sequence
  Synthetic oligonucleotide
agagcagtagaaacacatccagcaacagctcacctcttaacctaaaag

SEQ ID NO: 5783 - DNA, 38 bp, Artificial Sequence
  Synthetic oligonucleotide
gtctgccacagcccccgccattgccactgcaggtgctg

SEQ ID NO: 5784 - DNA, 485 bp, Artificial Sequence
  Synthetic oligonucleotide
cgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccg

SEQ ID NO: 5785 - DNA, 200 bp, Artificial Sequence
  Synthetic oligonucleotide
gtcctgaaggctgaccgaaacaataacagaggcagtaatagtagtcagaggttctatccatggattttgtttatcttgtaaaagagagacaacaggccttccagttgtccagggtctcagccagtcttcgactccatgttagtgtaaaacttctgcaccccatccatttccacctttcctctcctcccctataccttttt

SEQ ID NO: 5786 - DNA, 385 bp, Artificial Sequence
  Synthetic oligonucleotide
ctcattagaagaattcctcaattgctgcttcaacacccgccacgatggcgttcaacctggcagattaatttaacaactctctgatgggttgccctgaaatttgaaaaacagtgccttgggctgggcgcgatggctcacacctgtaatcccagcattttgggagaccgaggcgggcgaatcacctgaggtcgggagttggagaccagcctgaccaacatggagaaaccccatctctactaaaaatacaaaattagcggggcatggtggcgcatgcctgtaatcccagctactcgggaggctgaggcttgaacccgggaggcggaggttgcactgagccgagatcacgccattgcactgcagcctgggcaatgagcaaaactctgtc

SEQ ID NO: 5787 - DNA, 61 bp, Artificial Sequence
  Synthetic oligonucleotide
ggaaagtagaattacaaggaaaacgcttagagattgaacattcggtgcccaaaaaacaaag

SEQ ID NO: 5788 - DNA, 49 bp, Artificial Sequence
  Synthetic oligonucleotide
gagccggaaaattcaaatccgaaatattccaccccagctccgatgggaa

SEQ ID NO: 5789 - DNA, 52 bp, Artificial Sequence
  Synthetic oligonucleotide
gtactggacagcctgctggctcagtatggtacagtagagaactgtgagcaag

SEQ ID NO: 5790 - DNA, 64 bp, Artificial Sequence
  Synthetic oligonucleotide
tgaacaccgagagtgagacggcagtggtgaatgtcacctattccaaccgggagcagaccaggca

SEQ ID NO: 5791 - DNA, 195 bp, Artificial Sequence
  Synthetic oligonucleotide
gtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcag

SEQ ID NO: 5792 - DNA, 125 bp, Artificial Sequence
  Synthetic oligonucleotide
atgcatggtggacttaggaccttgctgggctgggggtctcactgcagagatgaagctgcttctggccctagcagggctcctggccattctggccacgccccagccctctgaaggtgctgctccag

SEQ ID NO: 5793 - DNA, 176 bp, Artificial Sequence
  Synthetic oligonucleotide
catcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactg

SEQ ID NO: 5794 - DNA, 124 bp, Artificial Sequence
  Synthetic oligonucleotide
atgtgctgacgcccgcccagctgaatgtgttgtccaagtcaagcggctgcgcctaccaggacgtgggggtgacttgcccggagcaggacaaataccgcaccatcaccgggatgtgcaacaacag

SEQ ID NO: 5795 - DNA, 130 bp, Artificial Sequence
  Synthetic oligonucleotide
acgcagccccacgctgggggcctccaaccgtgcctttgtgcgctggctgccggcggagtatgaggacggcttctctcttccctacggctggacgcccggggtcaagcgcaacggcttcccggtggctctg

SEQ ID NO: 5796 - DNA, 207 bp, Artificial Sequence
  Synthetic oligonucleotide
gctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaag

SEQ ID NO: 5797 - DNA, 319 bp, Artificial Sequence
  Synthetic oligonucleotide
atcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcag

SEQ ID NO: 5798 - DNA, 226 bp, Artificial Sequence
  Synthetic oligonucleotide
gtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaag

SEQ ID NO: 5799 - DNA, 495 bp, Artificial Sequence
  Synthetic oligonucleotide
gtaagcaggacctaggccaggagcgagtgggctgacagctaaaggtggggtagggatcaccttggctctagggagctagggtggggagcagtctgctttcctcccatcttggagatctggtctgactctctagcctcagttcctctgactctgcttccatatctgataataaacagtggggtggggatggccctcagagggaactggctacttcctatgtgttgtggctcgctgtgacccaggaagccagggcctgggagcatcccaatcttgcaagtctgaatggcataatctcctgagacctatatgtccctggggtcatgtagtgaccggtgaggacctgctcactggggccaccaccttggcaccaggcactgcttgtgcccagccctcttctcgaatcctcctgaccctacctggacttgtccctgactccaatctgagctctgatactgagccagatacttcccctgacctggctcctctggtccccag

SEQ ID NO: 5800 - DNA, 204 bp, Artificial Sequence
  Synthetic oligonucleotide
gatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcg

SEQ ID NO: 5801 - DNA, 194 bp, Artificial Sequence
  Synthetic oligonucleotide
atctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctg

SEQ ID NO: 5802 - DNA, 282 bp, Artificial Sequence
  Synthetic oligonucleotide
gccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgc

SEQ ID NO: 5803 - DNA, 487 bp, Artificial Sequence
  Synthetic oligonucleotide
ggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtctgaggaggaactggcgcttttgcagaggcttactctgggctctgagcttgaaccagtgtggtctgtgctcagggccctgtgtttctgaaccgagggtgaggatgttgg

SEQ ID NO: 5804 - DNA, 29 bp, Artificial Sequence
  Synthetic oligonucleotide
attgagctaagaggagctgacaatatcag

SEQ ID NO: 5805 - DNA, 94 bp, Artificial Sequence
  Synthetic oligonucleotide
ctgtcctgggggaggtggacacctcgttggtgctgagctccatggaggaggccaagcagctggtggacaaggcctacaaggagcggcgggaaag

SEQ ID NO: 5806 - DNA, 71 bp, Artificial Sequence
  Synthetic oligonucleotide
gggacacccgttccagtgagatgcccgagctcacctccatgcacaccctcttacttcgggagcacaaccgg

SEQ ID NO: 5807 - DNA, 90 bp, Artificial Sequence
  Synthetic oligonucleotide
ctggccacagagctcaagagcctgaaccctaggtgggatggggagaggctctaccaggaagcccggaagatcgtgggggccatggtccag

SEQ ID NO: 5808 - DNA, 30 bp, Artificial Sequence
  Synthetic oligonucleotide
atcatcacttaccgggactacctgcccctg

SEQ ID NO: 5809 - DNA, 104 bp, Artificial Sequence
  Synthetic oligonucleotide
gtggcattgaccccatcctccggggcctcatggccacccctgccaagctgaatcgtcagaaccaaattgcagtggatgagatccgggagcgattgtttgagcag

SEQ ID NO: 5810 - DNA, 67 bp, Artificial Sequence
  Synthetic oligonucleotide
gtcatgaggattgggctggacctgcctgctctgaacatgcagcgcagcagggaccacggcctcccag

SEQ ID NO: 5811 - DNA, 34 bp, Artificial Sequence
  Synthetic oligonucleotide
gtacccagttcaggaagctccgggatggtgatcg

SEQ ID NO: 5812 - DNA, 58 bp, Artificial Sequence
  Synthetic oligonucleotide
gttttggtgggagaacgagggtgtgttcagcatgcagcagcgacaggccctggcccag

SEQ ID NO: 5813 - DNA, 109 bp, Artificial Sequence
  Synthetic oligonucleotide
ctgggttccaatcctggctctgtggcttgctagctatgtgaccttgagcaaattaccctccttaaacaagagttttcttccttgtaaattacatctgtcatggtttctt

SEQ ID NO: 5814 - DNA, 682 bp, Artificial Sequence
  Synthetic oligonucleotide
gtaagttctccctgggaccccaggaaggagttgtcatccttattctatatgctgagtgctgtgttttacaggcaggttttggatatcagatataatgaacattcatctttggagagtgagtagagaatgaggggccctgtcagctgccacagccacacatcaaggcctctgggggctttgggctggctgaggactggtgctcctaaaactgagccctgggccaggggcatatgcttatcagagaaacacagcaggctgtgtgcagcttgacctgaaggctactgcggtctactgatatgtctagggtccctggaggcctctggagccataggtaccactcacacaggaggggtcactctggagcacacactcagaggccagcagccctgcaagtcttctgagatcaacctgactgtctctgggcctgtgccaggggacatgaaatactttgatgggcctctgttaccacagctccagtttcctggtggctgaggttggtaggtgtaggcagacacgctgcagggccaggggaggcaaagcattcaggacacatgtgcgtgtggccttcttgcccctgtttgcctggaggggtaatattataaatattccttctatggtcttctctctcccctgcaaccctaggaaggttttcctgattccccactccttatcgcccagtcca

SEQ ID NO: 5815 - DNA, 136 bp, Artificial Sequence
  Synthetic oligonucleotide
ggtattttgctgtagcagtggtgaagaaatcagcttctgacctcacctgggacaatctgaaaggcaagaagtcctgccatacggcagttggcagaaccgctggctggaacatccccatgggcctgctctacaataa

SEQ ID NO: 5816 - DNA, 241 bp, Artificial Sequence
  Synthetic oligonucleotide
ccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacag

SEQ ID NO: 5817 - DNA, 76 bp, Artificial Sequence
  Synthetic oligonucleotide
ggcctttctaggggcgatgctgtctctccctcagcatagggagtgggcccttccacctctggcctctctcccccag

SEQ ID NO: 5818 - DNA, 18 bp, Artificial Sequence
  Synthetic oligonucleotide
ggctgtgtctggctgtcc

SEQ ID NO: 5819 - DNA, 19 bp, Artificial Sequence
  Synthetic oligonucleotide
ctgataaaactgtgagatg

SEQ ID NO: 5820 - DNA, 38 bp, Artificial Sequence
  Synthetic oligonucleotide
gtgtgcagtgtcggagcatgaggccactaagtgccaga

SEQ ID NO: 5821 - DNA, 36 bp, Artificial Sequence
  Synthetic oligonucleotide
gtttccgcgaccatatgaaaagcgtcattccatccg

SEQ ID NO: 5822 - DNA, 9 bp, Artificial Sequence
  Synthetic oligonucleotide
atggtccca

SEQ ID NO: 5823 - DNA, 6 bp, Artificial Sequence
  Synthetic oligonucleotide
gtgttg

SEQ ID NO: 5824 - DNA, 47 bp, Artificial Sequence
  Synthetic oligonucleotide
cttgtgtgaagaaagcctcctaccttgattgcatcagggccattgcg

SEQ ID NO: 5825 - DNA, 69 bp, Artificial Sequence
  Synthetic oligonucleotide
gcaaacgaagcggatgctgtgacactggatgcaggtttggtgtatgatgcttacctggctcccaataac

SEQ ID NO: 5826 - DNA, 31 bp, Artificial Sequence
  Synthetic oligonucleotide
ctgaagcctgtggtggcagagttctatgggt

SEQ ID NO: 5827 - DNA, 9 bp, Artificial Sequence
  Synthetic oligonucleotide
caaaagagg

SEQ ID NO: 5828 - DNA, 54 bp, Artificial Sequence
  Synthetic oligonucleotide
gtaaaagcatggcctctccgctcccctccctcctcaagagtccggtggtgatga

SEQ ID NO: 5829 - DNA, 55 bp, Artificial Sequence
  Synthetic oligonucleotide
gccatgtttccctgcaccaggctgagggccttccattcacactgtgcctttgcag

SEQ ID NO: 5830 - DNA, 27 bp, Artificial Sequence
  Synthetic oligonucleotide
atccacagactttctattatgctgttg

SEQ ID NO: 5831 - DNA, 19 bp, Artificial Sequence
  Synthetic oligonucleotide
ctgtggtgaagaaggatag

SEQ ID NO: 5832 - DNA, 19 bp, Artificial Sequence
  Synthetic oligonucleotide
tggcttccagatgaaccag

SEQ ID NO: 5833 - DNA, 10 bp, Artificial Sequence
  Synthetic oligonucleotide
cttcgaggca

SEQ ID NO: 5834 - DNA, 7 bp, Artificial Sequence
  Synthetic oligonucleotide
agaagtc

SEQ ID NO: 5835 - DNA, 95 bp, Artificial Sequence
  Synthetic oligonucleotide
ctgccacacgggtctaggcaggtccgctgggtggaacatccccataggcttactttactgtgacttacctgagccacgtaaacctcttgagaaag

SEQ ID NO: 5836 - DNA, 81 bp, Artificial Sequence
  Synthetic oligonucleotide
cagtggccaatttcttctcgggcagctgtgccccttgtgcggatgggacggacttcccccagctgtgtcaactgtgtccag

SEQ ID NO: 5837 - DNA, 52 bp, Artificial Sequence
  Synthetic oligonucleotide
ggtgtggctgctccacccttaaccaatacttcggctactcgggagccttcaa

SEQ ID NO: 5838 - DNA, 19 bp, Artificial Sequence
  Synthetic oligonucleotide
gtgtctgaaggatggtgct

SEQ ID NO: 5839 - DNA, 37 bp, Artificial Sequence
  Synthetic oligonucleotide
ggggatgtggcctttgtcaagcactcgactatatttg

SEQ ID NO: 5840 - DNA, 83 bp, Artificial Sequence
  Synthetic oligonucleotide
agaacttggcaaacaaggctgacagggaccagtatgagctgctttgcctggacaacacccggaagccggtagatgaatacaag

SEQ ID NO: 5841 - DNA, 32 bp, Artificial Sequence
  Synthetic oligonucleotide
gactgccacttggcccaggtcccttctcatac

SEQ ID NO: 5842 - DNA, 64 bp, Artificial Sequence
  Synthetic oligonucleotide
cgtcgtggcccgaagtatgggcggcaaggaggacttgatctgggagcttctcaaccaggcccag

SEQ ID NO: 5843 - DNA, 44 bp, Artificial Sequence
  Synthetic oligonucleotide
gaacattttggcaaagacaaatcaaaagaattccaactattcag

SEQ ID NO: 5844 - DNA, 16 bp, Artificial Sequence
  Synthetic oligonucleotide
ctctcctcatgggaag

SEQ ID NO: 5845 - DNA, 19 bp, Artificial Sequence
  Synthetic oligonucleotide
gacctgctgtttaaggact

SEQ ID NO: 5846 - DNA, 16 bp, Artificial Sequence
  Synthetic oligonucleotide
ctgcccacgggttttt

SEQ ID NO: 5847 - DNA, 54 bp, Artificial Sequence
  Synthetic oligonucleotide
aaaagtcccccccaggatggatgccaagatgtacctgggctatgagtatgtcac

SEQ ID NO: 5848 - DNA, 9 bp, Artificial Sequence
  Synthetic oligonucleotide
tgccatccg

SEQ ID NO: 5849 - DNA, 20 bp, Artificial Sequence
  Synthetic oligonucleotide
gaatctacgggaaggcacat

SEQ ID NO: 5850 - DNA, 15 bp, Artificial Sequence
  Synthetic oligonucleotide
gcccagaagccccaa

SEQ ID NO: 5851 - DNA, 84 bp, Artificial Sequence
  Synthetic oligonucleotide
cagatgaatgcaagcctgtgaagtggtgtgcgctgagccaccacgagaggctcaagtgtgatgagtggagtgttaacagtgtag

SEQ ID NO: 5852 - DNA, 56 bp, Artificial Sequence
  Synthetic oligonucleotide
ggaaaatagagtgtgtatcagcagagaccaccgaagactgcatcgccaagatcatg

SEQ ID NO: 5853 - DNA, 94 bp, Artificial Sequence
  Synthetic oligonucleotide
aatggagaagctgatgccatgagcttggatggagggtttgtctacatagcgggcaagtgtggtctggtgcctgtcttggcagaaaactacaata

SEQ ID NO: 5854 - DNA, 33 bp, Artificial Sequence
  Synthetic oligonucleotide
agagcgataattgtgaggatacaccagaggcag

SEQ ID NO: 5855 - DNA, 9 bp, Artificial Sequence
  Synthetic oligonucleotide
gatcaacca

SEQ ID NO: 5856 - DNA, 11 bp, Artificial Sequence
  Synthetic oligonucleotide
ctgcagatttg

SEQ ID NO: 5857 - DNA, 83 bp, Artificial Sequence
  Synthetic oligonucleotide
atgaatttttcagtgaaggttgtgcccctgggtctaagaaagactccagtctctgtaagctgtgtatgggctcaggcctaaac

SEQ ID NO: 5858 - DNA, 29 bp, Artificial Sequence
  Synthetic oligonucleotide
ctgtgtgaacccaacaacaaagagggata

SEQ ID NO: 5859 - DNA, 24 bp, Artificial Sequence
  Synthetic oligonucleotide
ctacggctacacaggcgctttcag

SEQ ID NO: 5860 - DNA, 16 bp, Artificial Sequence
  Synthetic oligonucleotide
gtgtctggttgagaag

SEQ ID NO: 5861 - DNA, 12 bp, Artificial Sequence
  Synthetic oligonucleotide
ggagatgtggcc

SEQ ID NO: 5862 - DNA, 37 bp, Artificial Sequence
  Synthetic oligonucleotide
tttgtgaaacaccagactgtcccacagaacactgggg

SEQ ID NO: 5863 - DNA, 4 bp, Artificial Sequence
  Synthetic oligonucleotide
gaaa

SEQ ID NO: 5864 - DNA, 31 bp, Artificial Sequence
  Synthetic oligonucleotide
aaaccctgatccatgggctaagaatctgaat

SEQ ID NO: 5865 - DNA, 38 bp, Artificial Sequence
  Synthetic oligonucleotide
gaaaaagactatgagttgctgtgccttgatggtaccag

SEQ ID NO: 5866 - DNA, 16 bp, Artificial Sequence
  Synthetic oligonucleotide
gaaacctgtggaggag

SEQ ID NO: 5867 - DNA, 15 bp, Artificial Sequence
  Synthetic oligonucleotide
tatgcgaactgccac

SEQ ID NO: 5868 - DNA, 8 bp, Artificial Sequence
  Synthetic oligonucleotide
ctggccag

SEQ ID NO: 5869 - DNA, 13 bp, Artificial Sequence
  Synthetic oligonucleotide
agccccgaatcac

SEQ ID NO: 5870 - DNA, 49 bp, Artificial Sequence
  Synthetic oligonucleotide
gctgtggtcacacggaaagataaggaagcttgcgtccacaagatattac

SEQ ID NO: 5871 - DNA, 11 bp, Artificial Sequence
  Synthetic oligonucleotide
gtcaacagcag

SEQ ID NO: 5872 - DNA, 43 bp, Artificial Sequence
  Synthetic oligonucleotide
cacctatttggaagcaacgtaactgactgctcgggcaactttt

SEQ ID NO: 5873 - DNA, 47 bp, Artificial Sequence
  Synthetic oligonucleotide
gtttgttccggtcggaaaccaaggaccttctgttcagagatgacaca

SEQ ID NO: 5874 - DNA, 44 bp, Artificial Sequence
  Synthetic oligonucleotide
gtatgtttggccaaacttcatgacagaaacacatatgaaaaata

SEQ ID NO: 5875 - DNA, 56 bp, Artificial Sequence
  Synthetic oligonucleotide
cttaggagaagaatatgtcaaggctgttggtaacctgagaaaatgctccacctcat

SEQ ID NO: 5876 - DNA, 30 bp, Artificial Sequence
  Synthetic oligonucleotide
cactcctggaagcctgcactttccgtagac

SEQ ID NO: 5877 - DNA, 55 bp, Artificial Sequence
  Synthetic oligonucleotide
cttaaaatctcagaggtagggctgccaccaaggtgaagatgggaacgcagatgat

SEQ ID NO: 5878 - DNA, 206 bp, Artificial Sequence
  Synthetic oligonucleotide
ctccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtgga

SEQ ID NO: 5879 - DNA, 140 bp, Artificial Sequence
  Synthetic oligonucleotide
cggcccctcggaggacggagatcaccatcgtcaaaccccaggagtcagcccaccggaggatggagccccctgcctccaaggtccccgaggtgcccactgcccctgccaccgacgcagcccccaagagggtggagatccag

SEQ ID NO: 5880 - DNA, 148 bp, Artificial Sequence
  Synthetic oligonucleotide
atgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagg

SEQ ID NO: 5881 - DNA, 494 bp, Artificial Sequence
  Synthetic oligonucleotide
gcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagg

SEQ ID NO: 5882 - DNA, 192 bp, Artificial Sequence
  Synthetic oligonucleotide
gtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcag

SEQ ID NO: 5883 - DNA, 550 bp, Artificial Sequence
  Synthetic oligonucleotide
gtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggg

SEQ ID NO: 5884 - DNA, 592 bp, Artificial Sequence
  Synthetic oligonucleotide
attctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacag

SEQ ID NO: 5885 - DNA, 217 bp, Artificial Sequence
  Synthetic oligonucleotide
gggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccag

SEQ ID NO: 5886 - DNA, 169 bp, Artificial Sequence
  Synthetic oligonucleotide
ggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccaca

SEQ ID NO: 5887 - DNA, 192 bp, Artificial Sequence
  Synthetic oligonucleotide
ccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcg

SEQ ID NO: 5888 - DNA, 363 bp, Artificial Sequence
  Synthetic oligonucleotide
gtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctcc

SEQ ID NO: 5889 - DNA, 2179 bp, Artificial Sequence
  Synthetic oligonucleotide
ggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaagtgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttcttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcag

SEQ ID NO: 5890 - DNA, 927 bp, Artificial Sequence
  Synthetic oligonucleotide
gtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctag

SEQ ID NO: 5891 - DNA, 122 bp, Artificial Sequence
  Synthetic oligonucleotide
cttcgacatgctgccaggaaacaagggaaggggcctccctccgagtgagtcagtgatgaggccgcggcctccccgaggttgtggggaggctgcactggagccacaggcaggggtgagagcac

SEQ ID NO: 5892 - DNA, 151 bp, Artificial Sequence
  Synthetic oligonucleotide
ccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagccca

SEQ ID NO: 5893 - DNA, 139 bp, Artificial Sequence
  Synthetic oligonucleotide
ctgcccctcctggagcagaaagtgcctttatctcagccatccgcagactgcttggccagatgcggggacaggctggaatgagggaggcgtcttcatctccctgccatccccctctcacgccacccccgcccccaccggg

SEQ ID NO: 5894 - DNA, 169 bp, Artificial Sequence
  Synthetic oligonucleotide
gcgtgtccgtctgtctgtctagtgtctgggtttggcccaagactgggctgtagttacattaatgcccagccagccacccctgccactcacccctcctggcccaggccttgctgactctctgagctggggaggtgggaggccaggcgagcctgactctgttgatctaccc

SEQ ID NO: 5895 - DNA, 125 bp, Artificial Sequence
  Synthetic oligonucleotide
gtgcctgggcccctcccctcagagcccatggtaacgaacccctagaaaggagagaacgggcgtcaggggtgcacagtccacagctgaagagcaaggtttcgtggcagcacggcccggcccctcac

SEQ ID NO: 5896 - DNA, 115 bp, Artificial Sequence
  Synthetic oligonucleotide
gccttcctactaccggcccaggattagcgccctgggagcgcgcgccccgctgcctcgccgccacactttcctgggagcggcggccacggaggcaccatgaagaagtcttactcag

SEQ ID NO: 5897 - DNA, 57 bp, Artificial Sequence
  Synthetic oligonucleotide
gaggcacgcggacctccagtggccggctccggaggcttggtgactccagtggcccag

SEQ ID NO: 5898 - DNA, 77 bp, Artificial Sequence
  Synthetic oligonucleotide
ccttgaaaagatcttttgaggtcgaggaggtcgagacacccaactccaccccaccccggagggtccagactccccta

SEQ ID NO: 5899 - DNA, 4 bp, Artificial Sequence
  Synthetic oligonucleotide
gaac

SEQ ID NO: 5900 - DNA, 70 bp, Artificial Sequence
  Synthetic oligonucleotide
gccggggccatcggcccgtcccggttcgggctcaagagggccgaggtgttgggccacaagacgccagaac

SEQ ID NO: 5901 - DNA, 64 bp, Artificial Sequence
  Synthetic oligonucleotide
ggcagagcggcttgggtaaatccaccttaatcaacaccctcttcaaatccaaaatcagccggaa

SEQ ID NO: 5902 - DNA, 65 bp, Artificial Sequence
  Synthetic oligonucleotide
gtcggtgcagcccacctcagaggagcgcatccccaagaccatcgagatcaagtccatcacgcacg

SEQ ID NO: 5903 - DNA, 39 bp, Artificial Sequence
  Synthetic oligonucleotide
atattgaggagaaaggcgtccggatgaagctgacagtga

SEQ ID NO: 5904 - DNA, 43 bp, Artificial Sequence
  Synthetic oligonucleotide
ttgacacaccagggttcggggaccacatcaacaacgagaactg

SEQ ID NO: 5905 - DNA, 46 bp, Artificial Sequence
  Synthetic oligonucleotide
ctggcagcccatcatgaagttcatcaatgaccagtacgagaaatac

SEQ ID NO: 5906 - DNA, 92 bp, Artificial Sequence
  Synthetic oligonucleotide
ctgcaggaggaggtcaacatcaaccgcaagaagcgcatcccggacacccgcgtccactgctgcctctacttcatccccgccaccggccactc

SEQ ID NO: 5907 - DNA, 88 bp, Artificial Sequence
  Synthetic oligonucleotide
cctcaggcccctggacatcgagtttatgaaacgcctgagcaaggtggtcaacatcgtccctgtcatcgccaaggcggacacactcacc

SEQ ID NO: 5908 - DNA, 30 bp, Artificial Sequence
  Synthetic oligonucleotide
ctggaggagagggtccacttcaaacagcgg

SEQ ID NO: 5909 - DNA, 96 bp, Artificial Sequence
  Synthetic oligonucleotide
atcaccgcagacctgctgtccaacggcatcgacgtgtacccccagaaggaatttgatgaggactcggaggaccggctggtgaacgagaagttccgg

SEQ ID NO: 5910 - DNA, 97 bp, Artificial Sequence
  Synthetic oligonucleotide
gagatgatcccatttgctgtggtgggcagtgaccacgagtaccaggtcaacggcaagaggatccttgggaggaagaccaagtggggtaccatcgaag

SEQ ID NO: 5911 - DNA, 52 bp, Artificial Sequence
  Synthetic oligonucleotide
ttgaaaacaccacacactgtgagtttgcctacctgcgggaccttctcatcag

SEQ ID NO: 5912 - DNA, 7 bp, Artificial Sequence
  Synthetic oligonucleotide
gacgcac

SEQ ID NO: 5913 - DNA, 35 bp, Artificial Sequence
  Synthetic oligonucleotide
atgcagaacatcaaggacatcaccagcagcatcca

SEQ ID NO: 5914 - DNA, 39 bp, Artificial Sequence
  Synthetic oligonucleotide
cttcgaggcgtaccgtgtgaagcgcctcaacgagggcag

SEQ ID NO: 5915 - DNA, 63 bp, Artificial Sequence
  Synthetic oligonucleotide
cagcgccatggccaacggcgtggaggagaaggagccagaagccccggagatgtagacgccacc

SEQ ID NO: 5916 - DNA, 14 bp, Artificial Sequence
  Synthetic oligonucleotide
ctgcccacccccgg

SEQ ID NO: 5917 - DNA, 14 bp, Artificial Sequence
  Synthetic oligonucleotide
gatcctgcccccaa

SEQ ID NO: 5918 - DNA, 83 bp, Artificial Sequence
  Synthetic oligonucleotide
gtcatttccgtcccccccccaggccctcccaccaccccattttattttatatgattttctccatttgtcatcgttccccaccc

SEQ ID NO: 5919 - DNA, 68 bp, Artificial Sequence
  Synthetic oligonucleotide
gtgggctgcacgctcccctccatccccatcggccctgtcccctggagtgtgtcagagcccaggggaga

SEQ ID NO: 5920 - DNA, 11 bp, Artificial Sequence
  Synthetic oligonucleotide
atgcagcccac

SEQ ID NO: 5921 - DNA, 63 bp, Artificial Sequence
  Synthetic oligonucleotide
caggagcacctggaccccctgcccgccacatggtgtggccatcactcagcccctacccctgcc

SEQ ID NO: 5922 - DNA, 39 bp, Artificial Sequence
  Synthetic oligonucleotide
ctgctcctaagggtagaaaactccagggtcccctgccac

SEQ ID NO: 5923 - DNA, 32 bp, Artificial Sequence
  Synthetic oligonucleotide
cgactgcccagccactccaagccccctggcag

SEQ ID NO: 5924 - DNA, 62 bp, Artificial Sequence
  Synthetic oligonucleotide
ctgcaggtgctgctgatgcgctgggatctgattgaggataaaaaaggaaggagagatgaccc

SEQ ID NO: 5925 - DNA, 29 bp, Artificial Sequence
  Synthetic oligonucleotide
ctaccccctcatcccccagttttgaaaag

SEQ ID NO: 5926 - DNA, 10 bp, Artificial Sequence
  Synthetic oligonucleotide
gtctaagcaa

SEQ ID NO: 5927 - DNA, 90 bp, Artificial Sequence
  Synthetic oligonucleotide
gtgagtctggtggaggagctgagggagggagccatggaaggtgccagaaggaaggttggcgggggcacgtgtgggccgtggcttgggctg

SEQ ID NO: 5928 - DNA, 37 bp, Artificial Sequence
  Synthetic oligonucleotide
gtcagagtggcgtgagctgcccggcgcctgccctgcc

SEQ ID NO: 5929 - DNA, 31 bp, Artificial Sequence
  Synthetic oligonucleotide
caagtgaccagggaagtgtgtgtgtgtccat

SEQ ID NO: 5930 - DNA, 6 bp, Artificial Sequence
  Synthetic oligonucleotide
gtgtat

SEQ ID NO: 5931 - DNA, 91 bp, Artificial Sequence
  Synthetic oligonucleotide
cctctgtccccacgaggggacccatgggggctgtctttgcagggcacagatgaccaaagtcccttcctgcttcctgttacctgtcttgctc

SEQ ID NO: 5932 - DNA, 12 bp, Artificial Sequence
  Synthetic oligonucleotide
ctggggagaaag

SEQ ID NO: 5933 - DNA, 65 bp, Artificial Sequence
  Synthetic oligonucleotide
aggggcctgatgagactccactcaggtgcacacatcaccaggtgcatctgcaggcaccgggctgg

SEQ ID NO: 5934 - DNA, 89 bp, Artificial Sequence
  Synthetic oligonucleotide
ctgcttgcagccaggagaaggtcagcgagaaggagtgtatgagtgtgagtgtgtgtgcatggaagttggggcactgggcgtctgactcc

SEQ ID NO: 5935 - DNA, 47 bp, Artificial Sequence
  Synthetic oligonucleotide
ctccccacccaagagaggaaggacccctcaccacccccactggcgag

SEQ ID NO: 5936 - DNA, 25 bp, Artificial Sequence
  Synthetic oligonucleotide
acagtttactttgccgacttgccat

SEQ ID NO: 5937 - DNA, 18 bp, Artificial Sequence
  Synthetic oligonucleotide
gtttttgccaaaaccaag

SEQ ID NO: 5938 - DNA, 55 bp, Artificial Sequence
  Synthetic oligonucleotide
attttgaaggaaatgagtggccagcgccagggcccaggccatgtggcctgcccag

SEQ ID NO: 5939 - DNA, 22 bp, Artificial Sequence
  Synthetic oligonucleotide
cctcaatgtcacttggcggcgg

SEQ ID NO: 5940 - DNA, 23 bp, Artificial Sequence
  Synthetic oligonucleotide
ggtggggtgggggtgggcagcag

SEQ ID NO: 5941 - DNA, 5 bp, Artificial Sequence
  Synthetic oligonucleotide
catcc

SEQ ID NO: 5942 - DNA, 5 bp, Artificial Sequence
  Synthetic oligonucleotide
cagcc

SEQ ID NO: 5943 - DNA, 56 bp, Artificial Sequence
  Synthetic oligonucleotide
ttgagatgcttcactttccttctctgtaaccagactttgaaaaattgttcgtttca

SEQ ID NO: 5944 - DNA, 4 bp, Artificial Sequence
  Synthetic oligonucleotide
tcag

SEQ ID NO: 5945 - DNA, 17 bp, Artificial Sequence
  Synthetic oligonucleotide
gctctgttcctcaatgg

SEQ ID NO: 5946 - DNA, 108 bp, Artificial Sequence
  Synthetic oligonucleotide
ccttttgctacgtgcctcccgagaaatttgtctttttgtataaatgacaaagtgttgaaaatgtatttcctgaaataaatgtttcaaatgcagaaacccagaagactc

SEQ ID NO: 5947 - DNA, 211 bp, Artificial Sequence
  Synthetic oligonucleotide
gcaagccaaaaccctgggcagactcaatccaaaaataaacaatcaaagagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctgg

SEQ ID NO: 5948 - DNA, 131 bp, Artificial Sequence
  Synthetic oligonucleotide
cccagatttaccaaagggaattgtcagctgtccaagggctagcaaattcctaggtcacctagattggattttctgaccataaaaactgtgggccaggtgcacagctgcctgaggggctcaaacctgtgcag

SEQ ID NO: 5949 - DNA, 140 bp, Artificial Sequence
  Synthetic oligonucleotide
gccttatttctctgctggttgagcgaagggattgtcttccatggtctccgagatcccgtcccacgctcatgccctagaattctctgagtccttgatgcacttttgcctttggcgaggaggcaggacagtcaggcgtggag

SEQ ID NO: 5950 - DNA, 143 bp, Artificial Sequence
  Synthetic oligonucleotide
ctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 5951 - DNA, 130 bp, Artificial Sequence
  Synthetic oligonucleotide
ccccacccatctgggccccgggttcaagagagagcggggtctgatctcgtgtagccatatagagtttgcttctgagtgtctgctttgtttagtagaggtgggcaggaggagctgaggggctggggctggg

SEQ ID NO: 5952 - DNA, 140 bp, Artificial Sequence
  Synthetic oligonucleotide
ctttgcaatgaggaggagatctgggctgggcgggccagctggggaagcatttgactatctggaacttgtgtgtgcctcctcaggtatggcagtgactcacctggttttaataaaacaacctgcaacatctcaaaaaaagc

SEQ ID NO: 5953 - DNA, 93 bp, Artificial Sequence
  Synthetic oligonucleotide
tgtctctgagagcattgatgaggtcaggaagcctcctgttgggtagaggagcaactaagagactgaacttggcccccaccctgaggctcacaa

SEQ ID NO: 5954 - DNA, 103 bp, Artificial Sequence
  Synthetic oligonucleotide
gcttgaattgcacctgagttccaaaggagaagttgacattcttccagaacatatgcccagtgtcttcaacttgagatggagctgggatgccaagtctgcaaat

SEQ ID NO: 5955 - DNA, 47 bp, Artificial Sequence
  Synthetic oligonucleotide
cttggctggaggctctgcgaggacagctggggagaaggggagctgtg

SEQ ID NO: 5956 - DNA, 18 bp, Artificial Sequence
  Synthetic oligonucleotide
atggaggctcgctctgtt

SEQ ID NO: 5957 - DNA, 98 bp, Artificial Sequence
  Synthetic oligonucleotide
gccaggctggagtacagcgatctcggctcactgcaacctctgcctcccgggttcaagtgattctcctgcctcagcctcccaagtagctgggactacag

SEQ ID NO: 5958 - DNA, 78 bp, Artificial Sequence
  Synthetic oligonucleotide
actgcgccatggggctcagcgacggggaatggcagttggtgctgaacgtctgggggaaggtggaggctgacatcccag

SEQ ID NO: 5959 - DNA, 25 bp, Artificial Sequence
  Synthetic oligonucleotide
gccatgggcaggaagtcctcatcag

SEQ ID NO: 5960 - DNA, 80 bp, Artificial Sequence
  Synthetic oligonucleotide
gctctttaagggtcacccagagactctggagaagtttgacaagttcaagcacctgaagtcagaggacgagatgaaggcgt

SEQ ID NO: 5961 - DNA, 84 bp, Artificial Sequence
  Synthetic oligonucleotide
ttcatctcggaatgcatcatccaggttctgcagagcaagcatcccggggactttggtgctgatgcccagggggccatgaacaag

SEQ ID NO: 5962 - DNA, 29 bp, Artificial Sequence
  Synthetic oligonucleotide
gccctggagctgttccggaaggacatggc

SEQ ID NO: 5963 - DNA, 28 bp, Artificial Sequence
  Synthetic oligonucleotide
ctccaactacaaggagctgggcttccag

SEQ ID NO: 5964 - DNA, 23 bp, Artificial Sequence
  Synthetic oligonucleotide
ggctaggcccctgccgctcccac

SEQ ID NO: 5965 - DNA, 13 bp, Artificial Sequence
  Synthetic oligonucleotide
gtgttgaagttgg

SEQ ID NO: 5966 - DNA, 22 bp, Artificial Sequence
  Synthetic oligonucleotide
ctttgcatgcccagcgatgcgc

SEQ ID NO: 5967 - DNA, 45 bp, Artificial Sequence
  Synthetic oligonucleotide
ctccctgtgggatgtcatcaccctgggaaccgggagtggcccttg

SEQ ID NO: 5968 - DNA, 56 bp, Artificial Sequence
  Synthetic oligonucleotide
gctcactgtgttctgcatggtttggatctgaattaattgtcctttcttctaaatcc

SEQ ID NO: 5969 - DNA, 118 bp, Artificial Sequence
  Synthetic oligonucleotide
caaccgaacttcttccaacctccaaactggctgtaaccccaaatccaagccattaactacacctgacagtagcaattgtctgattaatcactggccccttgaagacagcagaatgtcc

SEQ ID NO: 5970 - DNA, 329 bp, Artificial Sequence
  Synthetic oligonucleotide
gggaagtaaaaatactgcttattaaaaacaaccacgaacccagcattgagctagaagcacagcagctccatttcaccctcagggtgactgtgcccgtgggcatgctcacgtagctacagttgccctggagcactgctgactagtgggcccaggtgaacacgtcctcgggtctatcatttgcagaaacctgggttctttctcttttgttttgttttgttttgttttgtttcattttgttttgttttgtttttgagacggagttttgctctcgtcacccaggctggagtccaatggcaccatcttggctcaccgcaacctccgcctcccag

SEQ ID NO: 5971 - DNA, 1042 bp, Artificial Sequence
  Synthetic oligonucleotide
ctgtgttaggatggtctcgatctcctgacctcgtgatccgcctgcctcggcctcccaaagtgctgggattacaggcgtgagccaccgcgcctagcaatatactattttttataactgtttattacttcctcccatattgcaaaattgatctttccaaatgttgcaaaagggggaaatagttcatttatgtaggtagtacacacactttatatgtttaagtacttacaagcatagtgaatttaagatcaaagacctggtttcaaatagaggcaacactacacagtaatttggaaactgaaaaagtcatccagtttctgtaagcttccttttgcttgtaaaaaacagaatgagctgtcttttaggttcacttttcagcatcctggtacatgagctgaagtgcatgatggcacatttaggttattcaagcattgtgatattaagaaggttcctggtgctttgatgagctttgcatcctaactgagctcctaaaaattctaagatgaaagttacagacattatgtaatttttttgtgtgtcatagtcttgggggttgttaatgaagaaataagactgtgtcatctgtatgtgaaattgatacaacttacctttgcagcattctcccagcaatccttatgagccccattgtgccccatgtgagcacttttcccagacaggcctgattctccctatgagtgctcacagccttctcctctccccacatgccacattccttccctctgccacgccatgcccgtctctgttcttcagagctacgttagatgccaccctctccaagaattcttcccaagcatctcccagttggaatatgttcacccaccactgcacgctgcacgttgatgtcttcacctgcgatttctgtggtctgtctgtgtagtctctaccacttgatgagctccggggcccaggaccatatctgagttccgtttacttaatggaagcctaagtgttcaaaattcacccacaaaactaaagttgtcaccaaggaggtttgcttttgcttttgtttttctacctacaatag

SEQ ID NO: 5972 - DNA, 208 bp, Artificial Sequence
  Synthetic oligonucleotide
attggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacgg

SEQ ID NO: 5973 - DNA, 123 bp, Artificial Sequence
  Synthetic oligonucleotide
gcaattactaaagatatgtttgaagaagcactgcgtgccctggcagatgatgatttcctgacagtgactgggaagaccgtgcgcttgctctgaagccttgtgagcaaggaaggctccctgcat

SEQ ID NO: 5974 - DNA, 135 bp, Artificial Sequence
  Synthetic oligonucleotide
ctcagttggccgccatcagtgtaaatagagcttaaagtcatggtttggctgcataaaaattttctaacttgggttcaatatttgtagtgaagtatctgttttcatttttttcacgttataaataaaaatactatg

SEQ ID NO: 5975 - DNA, 147 bp, Artificial Sequence
  Synthetic oligonucleotide
ctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccag

SEQ ID NO: 5976 - DNA, 229 bp, Artificial Sequence
  Synthetic oligonucleotide
aaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatgg

SEQ ID NO: 5977 - DNA, 123 bp, Artificial Sequence
  Synthetic oligonucleotide
gtgtatgtcactatgcccggctactttttgtattttttggtagagacggcttcgccacgttgcccaggctgcaagcgatatgcctaggctcaagcgatctgcccacctcaacttccggaagtg

SEQ ID NO: 5978 - DNA, 550 bp, Artificial Sequence
  Synthetic oligonucleotide
ccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgag

SEQ ID NO: 5979 - DNA, 21 bp, Artificial Sequence
  Synthetic oligonucleotide
gcttatgtagacatgaggaag

SEQ ID NO: 5980 - DNA, 84 bp, Artificial Sequence
  Synthetic oligonucleotide
ggatgagtgccacctctcgtaaacggaaagaagaattagctgaagcattgaaaaagcttattttatctaagggcaaaacaccag

SEQ ID NO: 5981 - DNA, 32 bp, Artificial Sequence
  Synthetic oligonucleotide
ctctaaaataccagcaactttttgaagatatt

SEQ ID NO: 5982 - DNA, 18 bp, Artificial Sequence
  Synthetic oligonucleotide
cggggacaatctgacata

SEQ ID NO: 5983 - DNA, 25 bp, Artificial Sequence
  Synthetic oligonucleotide
gtcctgcttgctgcacgccacatgg

SEQ ID NO: 5984 - DNA, 13 bp, Artificial Sequence
  Synthetic oligonucleotide
gtgtggtctgcat

SEQ ID NO: 5985 - DNA, 24 bp, Artificial Sequence
  Synthetic oligonucleotide
ctggccgggcgcggtggctcacac

SEQ ID NO: 5986 - DNA, 4 bp, Artificial Sequence
  Synthetic oligonucleotide
ctac

SEQ ID NO: 5987 - DNA, 17 bp, Artificial Sequence
  Synthetic oligonucleotide
tcgggaggttgaggcag

SEQ ID NO: 5988 - DNA, 34 bp, Artificial Sequence
  Synthetic oligonucleotide
gagaatcgcttaaacccaggcggcagaggttgca

SEQ ID NO: 5989 - DNA, 69 bp, Artificial Sequence
  Synthetic oligonucleotide
gtgagccaagatcgcgccactgcactccagcctcagcaatagagtgagactgtctcaaaaaaaaaaaaa

SEQ ID NO: 5990 - DNA, 96 bp, Artificial Sequence
  Synthetic oligonucleotide
cacttctttttttgagatagggtcttactctgtcaccctggctagagtacactggtacaatcacggctcaatgtaggcttaacctcctgggctcag

SEQ ID NO: 5991 - DNA, 12 bp, Artificial Sequence
  Synthetic oligonucleotide
ctgagattacag

SEQ ID NO: 5992 - DNA, 11 bp, Artificial Sequence
  Synthetic oligonucleotide
gtgtgagccac

SEQ ID NO: 5993 - DNA, 5 bp, Artificial Sequence
  Synthetic oligonucleotide
tgcac

SEQ ID NO: 5994 - DNA, 340 bp, Artificial Sequence
  Synthetic oligonucleotide
gtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatg

SEQ ID NO: 5995 - DNA, 133 bp, Artificial Sequence
  Synthetic oligonucleotide
atctctatttcaaatgagaccaaagatctgcttctggcagctgtcagtgaggactcatctgttacccagatctaccatgcagttgcagctctaagtggctttggccttcccttggcatcccaagaagcactca

SEQ ID NO: 5996 - DNA, 166 bp, Artificial Sequence
  Synthetic oligonucleotide
gatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacagg

SEQ ID NO: 5997 - DNA, 306 bp, Artificial Sequence
  Synthetic oligonucleotide
tgctggctctgtcaccctgccaactcatttaatgcttgtgccttgtgatctgtaaattggatctgtaaacctacctgccttgttgaattctttattttgaaacacctgaaagaaaagctctgggtagttatcaagttttggtccagttctaatgtgcagacaccttggtttcttgtgccattagtggggataaagtgattagactcagtaccatcgtattgctattaactactatttgttgactagctagcatataccgttccctgcactaatgcttagcatatggtattgcaaatcttcacacag

SEQ ID NO: 5998 - DNA, 628 bp, Artificial Sequence
  Synthetic oligonucleotide
atatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctag

SEQ ID NO: 5999 - DNA, 348 bp, Artificial Sequence
  Synthetic oligonucleotide
ttcagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcag

SEQ ID NO: 6000 - DNA, 927 bp, Artificial Sequence
  Synthetic oligonucleotide
ttgagatggagtcttgctctgtctcgcccaggctggagtgcaacggtgcgatcttggctcactgcagcctctgcctcccaggttcaggcgattctcccacctcagcctcccaagtagctgggattataggcctgcgccaccacacctggctaattttatatttttagtagagagagggtttcaccatgttggccagggtggtctcgaatgcctgacctcaagtgatccttctgcctcggcctcccaaagtgctgggattacaggtgtgagctcccgcacccagcctatttatatcctgtgtatttttgttaagaatttgaaaaatgaatgccaagtataacatgacagaggagttttaaacaaaagcagagaaatagttgtaagcaggaacatggcacaggtcgctgaagtccaattgttacccctgtttgtgggtgtgtgtgtgggtgtgtgtgtgttttgagacgaggtatcactgtcacccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgctg

SEQ ID NO: 6001 - DNA, 486 bp, Artificial Sequence
  Synthetic oligonucleotide
gagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaaaaaaaaaaagattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttg

SEQ ID NO: 6002 - DNA, 96 bp, Artificial Sequence
  Synthetic oligonucleotide
aaagcatgtacctacatcagatctaaccttgatcccagcaatgtggattccctcttctacgctgcccaggccagccaggccctctcaggatgtgag

SEQ ID NO: 6003 - DNA, 43 bp, Artificial Sequence
  Synthetic oligonucleotide
gtgcccttactgctcgtctcagcaaggaggagactgtgctggc

SEQ ID NO: 6004 - DNA, 76 bp, Artificial Sequence
  Synthetic oligonucleotide
aacagtccaggctctgcagacagcatcccacctgtcccagcaggctgacctgaggagcatcgtggaggagattgag

SEQ ID NO: 6005 - DNA, 105 bp, Artificial Sequence
  Synthetic oligonucleotide
gaccttgttgctcgcctggatgaactcgggggcgtgtatctccagtttgaagaaggactggaaacaacagcgttatttgtggctgccacctacaagctcatggat

SEQ ID NO: 6006 - DNA, 30 bp, Artificial Sequence
  Synthetic oligonucleotide
catgtggggactgagccatccattaaggag

SEQ ID NO: 6007 - DNA, 11 bp, Artificial Sequence
  Synthetic oligonucleotide
ctatcttgcgg

SEQ ID NO: 6008 - DNA, 119 bp, Artificial Sequence
  Synthetic oligonucleotide
ttgcaagtcaccaatgttctgtctcagcctctgactcaggccactgttaaactagaacatgctaaatctgttgcttccagagccactgtcctccagaagacatccttcacccctgtagg

SEQ ID NO: 6009 - DNA, 28 bp, Artificial Sequence
  Synthetic oligonucleotide
ggatgtttttgaactaaatttcatgaac

SEQ ID NO: 6010 - DNA, 78 bp, Artificial Sequence
  Synthetic oligonucleotide
gtcaaattttccagtggttattatgacttccttgtcgaagttgaaggtgacaaccggtatattgcaaataccgtagag

SEQ ID NO: 6011 - DNA, 5 bp, Artificial Sequence
  Synthetic oligonucleotide
ctcag

SEQ ID NO: 6012 - DNA, 23 bp, Artificial Sequence
  Synthetic oligonucleotide
agtcaagatctccactgaagttg

SEQ ID NO: 6013 - DNA, 64 bp, Artificial Sequence
  Synthetic oligonucleotide
gcatcacaaatgttgatctttccaccgtggataaggatcagagcattgcacccaaaactacccg

SEQ ID NO: 6014 - DNA, 63 bp, Artificial Sequence
  Synthetic oligonucleotide
ggtgacatacccagccaaagccaagggcacattcatcgcagacagccaccagaacttcgcctt

SEQ ID NO: 6015 - DNA, 52 bp, Artificial Sequence
  Synthetic oligonucleotide
gttcttccagctggtagatgtgaacactggtgctgaactcactcctcaccag

SEQ ID NO: 6016 - DNA, 101 bp, Artificial Sequence
  Synthetic oligonucleotide
acatttgtccgactccataaccagaagactggccaggaagtggtgtttgttgccgagccagacaacaagaacgtgtacaagtttgaactggatacctctga

SEQ ID NO: 6017 - DNA, 42 bp, Artificial Sequence
  Synthetic oligonucleotide
aagaaagattgaatttgactctgcctctggcacctacactct

SEQ ID NO: 6018 - DNA, 52 bp, Artificial Sequence
  Synthetic oligonucleotide
ctacttaatcattggagatgccactttgaagaacccaatcctctggaatgtg

SEQ ID NO: 6019 - DNA, 67 bp, Artificial Sequence
  Synthetic oligonucleotide
gctgatgtggtcatcaagttccctgaggaagaagctccctcgactgtcttgtcccagaaccttttca

SEQ ID NO: 6020 - DNA, 20 bp, Artificial Sequence
  Synthetic oligonucleotide
ctccaaaacaggaaattcag

SEQ ID NO: 6021 - DNA, 35 bp, Artificial Sequence
  Synthetic oligonucleotide
cacctgttccgcgagcctgagaagaggccccccac

SEQ ID NO: 6022 - DNA, 61 bp, Artificial Sequence
  Synthetic oligonucleotide
cgtggtgtccaatacattcactgccctgatcctctcgccgttgcttctgctcttcgctctg

SEQ ID NO: 6023 - DNA, 35 bp, Artificial Sequence
  Synthetic oligonucleotide
tggatccggattggtgccaatgtctccaacttcac

SEQ ID NO: 6024 - DNA, 41 bp, Artificial Sequence
  Synthetic oligonucleotide
ttttgctcctagcacgattatatttcacctgggacatgctg

SEQ ID NO: 6025 - DNA, 75 bp, Artificial Sequence
  Synthetic oligonucleotide
ctatgctgggactcatgtatgtctactggactcagctcaacatgttccagaccttgaagtacctggccatcttgg

SEQ ID NO: 6026 - DNA, 22 bp, Artificial Sequence
  Synthetic oligonucleotide
gcagtgtgacgtttctggctgg

SEQ ID NO: 6027 - DNA, 22 bp, Artificial Sequence
  Synthetic oligonucleotide
caatcggatgctggcccagcag

SEQ ID NO: 6028 - DNA, 7 bp, Artificial Sequence
  Synthetic oligonucleotide
gcagtca

SEQ ID NO: 6029 - DNA, 4 bp, Artificial Sequence
  Synthetic oligonucleotide
agag

SEQ ID NO: 6030 - DNA, 5 bp, Artificial Sequence
  Synthetic oligonucleotide
aacag

SEQ ID NO: 6031 - DNA, 14 bp, Artificial Sequence
  Synthetic oligonucleotide
cacattagttccag

SEQ ID NO: 6032 - DNA, 40 bp, Artificial Sequence
  Synthetic oligonucleotide
aagaaagatggaaattctgaaaactgaatgtcaagaaaag

SEQ ID NO: 6033 - DNA, 295 bp, Artificial Sequence
  Synthetic oligonucleotide
ccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggg

SEQ ID NO: 6034 - DNA, 159 bp, Artificial Sequence
  Synthetic oligonucleotide
gtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccg

SEQ ID NO: 6035 - DNA, 125 bp, Artificial Sequence
  Synthetic oligonucleotide
ggccagctgccctcacgctgggggtccagccatcccctgcccagttcagccgctggatccagactggggccatctgtggcgctcccccgctggagggatagtcaggagcagcagtgctgtgccag

SEQ ID NO: 6036 - DNA, 303 bp, Artificial Sequence
  Synthetic oligonucleotide
gcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgat

SEQ ID NO: 6037 - DNA, 371 bp, Artificial Sequence
  Synthetic oligonucleotide
gtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattag

SEQ ID NO: 6038 - DNA, 235 bp, Artificial Sequence
  Synthetic oligonucleotide
cttcctgggggccttggctttgatctacaatgaagccctcaagggctgaaaataaatagggaagatggagacaccctctgggggtcctctctgagtcaaatccagtggtgggtaattgtacaataaattttttttggtcaaatttacccttgcgtcctggcttccgaatgatttctgttcctccttggcttagtgggacaccagccattggaagatttgctcacggtcaacctct

SEQ ID NO: 6039 - DNA, 13 bp, Artificial Sequence
  Synthetic oligonucleotide
gtaaaccgcgaat

SEQ ID NO: 6040 - DNA, 9 bp, Artificial Sequence
  Synthetic oligonucleotide
gtgcgttgt

SEQ ID NO: 6041 - DNA, 15 bp, Artificial Sequence
  Synthetic oligonucleotide
gtgagttctctccag

SEQ ID NO: 6042 - DNA, 20 bp, Artificial Sequence
  Synthetic oligonucleotide
gagccctgggtactttccag

SEQ ID NO: 6043 - DNA, 110 bp, Artificial Sequence
  Synthetic oligonucleotide
gccattgtgtgtggcctgagactgggtggttccaaaggaggcggggctagtgcaggcagcattattggggtgtgtgggtgagaagtccttgctcccatggcactgactag

SEQ ID NO: 6044 - DNA, 15 bp, Artificial Sequence
  Synthetic oligonucleotide
gccctctgctgccag

SEQ ID NO: 6045 - DNA, 33 bp, Artificial Sequence
  Synthetic oligonucleotide
ctccaagcccagccctcagccatggcatgcccc

SEQ ID NO: 6046 - DNA, 9 bp, Artificial Sequence
  Synthetic oligonucleotide
ctggatcag

SEQ ID NO: 6047 - DNA, 49 bp, Artificial Sequence
  Synthetic oligonucleotide
gccattggcctcctcgtggccatcttccacaagtactccggcagggagg

SEQ ID NO: 6048 - DNA, 19 bp, Artificial Sequence
  Synthetic oligonucleotide
gtgacaagcacaccctgag

SEQ ID NO: 6049 - DNA, 29 bp, Artificial Sequence
  Synthetic oligonucleotide
caagaaggagctgaaggagctgatccaga

SEQ ID NO: 6050 - DNA, 20 bp, Artificial Sequence
  Synthetic oligonucleotide
aggagctcaccattggctcg

SEQ ID NO: 6051 - DNA, 9 bp, Artificial Sequence
  Synthetic oligonucleotide
aagctgcag

SEQ ID NO: 6052 - DNA, 77 bp, Artificial Sequence
  Synthetic oligonucleotide
gatgctgaaattgcaaggctgatggaagacttggaccggaacaaggaccaggaggtgaacttccaggagtatgtcac

SEQ ID NO: 6053 - DNA, 150 bp, Artificial Sequence
  Synthetic oligonucleotide
gagaaacgcgacgccttgggccgctctgccgaatgcaaccgcgcccccaggagacccggtgcccgccctcctaccattccacgcggctcgagcccgcgtgcgggcctctttcaggccgctcctagtggacgcagaggcgggccgaggacg

SEQ ID NO: 6054 - DNA, 1876 bp, Artificial Sequence
  Synthetic oligonucleotide
gtgagtgacgccgacggacaccctcggccaggcacagatccgccctccggctccaaccactcccgccgcgcggggcaggacgggcctcggccctgagctgggccctctgggaccaccgagagataggcctccgcgccgtccagagcggcccggaagtggccctgcacgggccagaggcgaccgtggtcgggacggaaatggctcccgtttgctgttctctcggtgaacgcgagccttatggcgatcagttctgtggcatcgttcctcctgctcgtttattctttcactcattcactcatgccctgccgcgccatcatttcttcccacattcatttattcgttcatcagtccccagccccgggtagtttcggagctcaccaggctgggctcgcctcccagcctccggagctgcccgcacaggcctcgcgccacctggccgcagcttcctcccctttatccactccgtatttgtttgtccagcctaggccttgggggttgtgggggagacacaagtacccgtgactggtcggacaagtgcccgttgttgggggcgtgggcgctgggactgacgcgggaggtggctctgatcatgtcgaggtgaggaggaggcgttgaggctcagaaagggcacgcagcgtggacgtgaggacgtcggggaggctggagcagtgaggccgacaggaaggaccttacggggctcacatgctatcccacgacgaggacggactcaggacggcagccctgatagatgcggctgggggctggcgggtcggggtcgcacaccacaggatggaggggcagcggtgcctggctccgccttaagaaacatgggcccttgggggacccggatttctgatacttcaatacacaaatatggatttttattgaaatcagatgtcgtttttttaaaatttaacttttgatttgaggtaattataaattcacatgcagtaacaagtaatgcataccctatgtacgctttacccaattcccctaaaggtggcatcttgaaaaactagaggccaggtgcggtggctcatgtctgtaatcccagcactttgggaggccaaggcgggtggatcccttgagctcaggagttaaagaccagcctgagcaacatggtgaaaccccatctgtactgaaaacacaaaaattaggcgggtgtggaggctggtgcctgtaatcccagctactcgggagtctcaggcaggagaatcgcttgtacccaggaggcggaggtcgcggtgagcccacatcacgccactgcactccaacctgggcaacagagcgagactctgtctcaaaaaaagagaagagaaagaaaaactagagtacaatatcacaactgagatgcagaatatttccatcacgaaggatccccgtgttgcccttacagagccgcatacccttccctcctacctctgctccccgttaacctctttttgtcaactagtaatctgttctcatttctaccattttgtcattttacgaatgttgcataggctgggcgaggtgtctcgcgcctgtaatactagcactttgggaggccgaggcgggtggaccatctgaggtcaagagttcaggaccggcccaccggccgggtgccgtggctcacgcctgtaatcccagcactttgggaggctgaggcgggcggatcacgaggtcaggagatcgagaccatcctggctaacacggtgaaaccccggctctaccaaaaatataaaaaaattagccgggcatggtggcaggcgcctgtagtcccagctacttgggaggctgaggcaggagaatggtatgaacccgggaggcagagcttgcagtgagccaggatagcgccactggactccagcctgggcgacagagcaagactcttctc

SEQ ID NO: 6055 - DNA, 164 bp, Artificial Sequence
  Synthetic oligonucleotide
cccgccttccgggaaggacaaacacgggaagaggtcagtgcccgagccacccccaccgccctccctcggggcctcattgctgcagacgctcaccccagacactcactgcaccggagtgagcgcgaccatcatgtccatgctcgtggtctttctcttgctgtggg

SEQ ID NO: 6056 - DNA, 270 bp, Artificial Sequence
  Synthetic oligonucleotide
tttatgagacgcagcccagcctgtgggcagagtccgaatcactgctgaaacccttggccaatgtgacgctgacgtgccaggcccgcctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaa

SEQ ID NO: 6057 - DNA, 273 bp, Artificial Sequence
  Synthetic oligonucleotide
agtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcg

SEQ ID NO: 6058 - DNA, 410 bp, Artificial Sequence
  Synthetic oligonucleotide
gtgaggccgggtgcagtggctcacgcctataatcccagcactttgggaggctgaggccagcggatcatgaggtcaagagatcgagaccagtctacccaacatgacgaaaccccgtctctactaaaaatacaaaaattagccaggtgtggtggcaggtgcctgtagtaccagctactcaggaggctgaggcaggagaatcccttgaacctgggaggcagagcttgcagtgagctgagtggcgccactgcactccagcctgggcaacaagagcgaaactccgtttcaaaaaaaaaaaaaaaaaagaatggaagggtgttcctgggattgccacccggagggcagaggtctggggactgggcagagggcagctccagggatggggcagcctagtaatgctgcctgcattgcag

SEQ ID NO: 6059 - DNA, 230 bp, Artificial Sequence
  Synthetic oligonucleotide
ctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctac

SEQ ID NO: 6060 - DNA, 271 bp, Artificial Sequence
  Synthetic oligonucleotide
agacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagct

SEQ ID NO: 6061 - DNA, 524 bp, Artificial Sequence
  Synthetic oligonucleotide
tacccaggctggtctggaactcctgagctcaggcaatccgcctgcctcggcctctcaaagtgctgagattacaggtgtgagccactgcgcccggcaccttaaatacacttttaaagttaaacttatggagggaaaaccctcatctattgacatagattgtatgtccttttttggtccctccatgaaggagcaccgttttctccatcatttcttcttcccttcacccgtcagagtgaccgaggctggggaccccagaagccccagagcaggcccgaatctgggacttccacggtcctgggggaggggtgcggggacactcacgtgtggcgcggatgtccggggtgtgaaggcagcgggcgcagctcggcggcgccggaggagccctctgcgcccaggaacaagacagggaagatgaagccggggctgaggcgcaggcgcgggcgcggcctggggtgtggcctggggcgtggcctgggcgcggcctggggcgtggcctggcccgaccacccgcccgctccgcccag

SEQ ID NO: 6062 - DNA, 143 bp, Artificial Sequence
  Synthetic oligonucleotide
gaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacg

SEQ ID NO: 6063 - DNA, 1834 bp, Artificial Sequence
  Synthetic oligonucleotide
ggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgtttaaaatgtctttggactcccagggctgagtgggctgggatctcgtgtcctcaaagtggatgggttctggggtggctcctgaggtagaggagtggagaactggctcttaagagcacagttttcttttcttttttcttttttgagacagggtctcacactgtcacccaggctggagtgcagtgttgcagtccggctcactgcagttttgacctcccaggctcaagcgatcctcctgcctcagcctcccaagtagctgggagcctgggcatgcatcgccacgtctggctaattattattttttgtagacagggtctcactgtgttgcccaagcttgtcttgaactcctggccttaagtgatcctcccacctcagcctcctgagtagctgggactacaggcatgagccaccatgcctggccaactcacatttttctttctattatttattttttgtagagatgagtctcactatgttgcccaggctggtcttgaactcttgggctcaagtgatcctcccgcctcagcctcccaaagtgttgggattacaggtgtgagccacagcacctggccaaccaacacttctcagggcctctttcatctgtgctcttccaggatgctgcctcttactccctgggcacctcggcctggtcccagcaggtatgggcaggttgcttgaggctccagacatactcacctctacctcgaccacatcaaccccatcaccaagaggaggttcagggaagctgcattttgtggtcttgtcctcccagtccagggtggtagtgctgggctgttcccagcctcccacagcagagctggacgctgtggaaatggctggattcctctgtgttctttcccattatccctcagctctgagtcctcttgtgccatctgacatctgatgccttcccaaccactgccgagtttctgcctggagcagggcctcaaggccctggcacacagaagatgcgtatcagtattatcaaccaatagttgatgaattgtgtttttcaacgaatttgctagtgatctggtttactgccttagtaatatctagttcctaatatgcctatgccttttaatgtctgcacagtctgtgatgatgtcacttctctcaagcctgatgtgtcctctctctctttcttgctagtggtttatcaatttttaaaaccttttcttgtttatttgtttttgagacagaattttgctcttgttgcccaggctggagtgcaatggcgtgatcttggctcacagcaacctctacctcctgggttcaagtgattctcgtgcctcagcctcctgagtagctgggctgacaggcacccaccaccacacccagctaatttttatgtttttagtagagatggggtttcaccttgttgggtggccaggctggtctccaactcctgagctcaggtgatccacccgcctcagcctcccaaagtgctgggattacaggggtgagccaccacgcccagccccagcttagttttttaaaaagtttattttagccattctaataggtatgtagacatatctaatagtggttttccttgcgtttccttaatgtctgatgatgttaagcattttttccccaagtgcttagttgccatctatatagcatctttgatgaaatgtctgtttatatattttgcacactttaaaatattgggttgttttcttt

SEQ ID NO: 6064 - DNA, 76 bp, Artificial Sequence
  Synthetic oligonucleotide
gtgaggcctcctggggtctgggtccctggggcgggagggggcgggaacaggagccttacgggggctgtctccgcag

SEQ ID NO: 6065 - DNA, 36 bp, Artificial Sequence
  Synthetic oligonucleotide
gtgtcacctggggcccagtgacagaagcagccatat

SEQ ID NO: 6066 - DNA, 12 bp, Artificial Sequence
  Synthetic oligonucleotide
gtgagtgcaggg

SEQ ID NO: 6067 - DNA, 82 bp, Artificial Sequence
  Synthetic oligonucleotide
gtgaggtctgggaatggtgggcccaggccgggggggagccctgtctctgtggcactgagctgatcccagccaccccttgcag

SEQ ID NO: 6068 - DNA, 98 bp, Artificial Sequence
  Synthetic oligonucleotide
gtgactgtgggaaccatctctgggggctgctgggggaggaggatacagggggcatgaccacattcatcctgacctccatgctgaatgtccttgcccag

SEQ ID NO: 6069 - DNA, 87 bp, Artificial Sequence
  Synthetic oligonucleotide
gaccaggtccaggaagctggccacacggttgcctgggtctgatggttgcaaaggagtttgggcagaggatgcccaaagaatggaagg

SEQ ID NO: 6070 - DNA, 67 bp, Artificial Sequence
  Synthetic oligonucleotide
cggctgcatgacaaccaaaacggctggtccggggacagcgcgccggtcgagctgattctgagcgatg

SEQ ID NO: 6071 - DNA, 4 bp, Artificial Sequence
  Synthetic oligonucleotide
gcac

SEQ ID NO: 6072 - DNA, 7 bp, Artificial Sequence
  Synthetic oligonucleotide
gtggacg

SEQ ID NO: 6073 - DNA, 71 bp, Artificial Sequence
  Synthetic oligonucleotide
gtccgcacccccggggccgcggcgaacctcgagctgatcttcgtggggccccagcacgccggcaactacag

SEQ ID NO: 6074 - DNA, 10 bp, Artificial Sequence
  Synthetic oligonucleotide
gtgccgctac

SEQ ID NO: 6075 - DNA, 64 bp, Artificial Sequence
  Synthetic oligonucleotide
cgctcctgggtgccccacaccttcgaatcggagctcagcgaccctgtggagctcctggtggcag

SEQ ID NO: 6076 - DNA, 18 bp, Artificial Sequence
  Synthetic oligonucleotide
aaagctgatgcagccgcg

SEQ ID NO: 6077 - DNA, 307 bp, Artificial Sequence
  Synthetic oligonucleotide
gcggtcagcccaaggtcacttgacccagtcagtgtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccag

SEQ ID NO: 6078 - DNA, 447 bp, Artificial Sequence
  Synthetic oligonucleotide
gtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctc

SEQ ID NO: 6079 - DNA, 523 bp, Artificial Sequence
  Synthetic oligonucleotide
gtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttca

SEQ ID NO: 6080 - DNA, 1288 bp, Artificial Sequence
  Synthetic oligonucleotide
ctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttaggtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttag

SEQ ID NO: 6081 - DNA, 439 bp, Artificial Sequence
  Synthetic oligonucleotide
gctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacatttaaaaaa

SEQ ID NO: 6082 - DNA, 88 bp, Artificial Sequence
  Synthetic oligonucleotide
tccgggcgcggaggtttgcgcgccttggtgagccgttggcgtggtggtcccggagtgatcctggcagccggtggggaagacaaggagg

SEQ ID NO: 6083 - DNA, 92 bp, Artificial Sequence
  Synthetic oligonucleotide
gtttgagcatggcagaaggaaacaccctgatatcagtggattatgaaatttttgggaaggtgcaaggggtgtttttccgtaagcatactcag

SEQ ID NO: 6084 - DNA, 79 bp, Artificial Sequence
  Synthetic oligonucleotide
gaaatgactgttgaaaacagaattgctgaaactcacagcaagagctgtgttccagttagctttgctaccagttatgcag

SEQ ID NO: 6085 - DNA, 77 bp, Artificial Sequence
  Synthetic oligonucleotide
ttttgagacagagtcttgctctgttgcctaggctaaagtgcagtagtgcgatctcggctcactgcaacctccacttc

SEQ ID NO: 6086 - DNA, 114 bp, Artificial Sequence
  Synthetic oligonucleotide
ctttgtttttgggaggctgaggaaggaggatcatttgagcctgggaggttaaggctgcaataagctgtgactgtgccaccatccttcagaaaaaaaaaagaaaaaggaaaagag

SEQ ID NO: 6087 - DNA, 49 bp, Artificial Sequence
  Synthetic oligonucleotide
ctatttaccatataagataactcttaagaactggagatagtcagctccc

SEQ ID NO: 6088 - DNA, 531 bp, Artificial Sequence
  Synthetic oligonucleotide
ccaacgttggtgccagtagatattcaatgcattgtaagaatgagtttgtcttaaaaatttttttaaagcaaattctatgcgtcaggcactgttcaaagtgccggggatacagcgtggaacagttattaaattaacaagtaccctctgaaatagactctattaataccccaattttagaaataaacaaactgaagcccagagaagcaaagtaccctagtatcctgcccaaggtcacttgggtacaaggccaagaacaaccacagtcatgatattgacatctgcggagcttaccacgtgccaaacaccgtgcgaatccgcacagaatccgcacacccaccggttggggcagggacatctctgccactgatgcggagaggaaacggattcccgaggctcctgagagggatcctgggttccattcaccacacctcgctgctttttactgattcagttggaactggaagggaaaacaacggagctgatgagctccaaaaatgctccggggaccatctccctctcgcccgttcgcag

SEQ ID NO: 6089 - DNA, 150 bp, Artificial Sequence
  Synthetic oligonucleotide
gactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcg

SEQ ID NO: 6090 - DNA, 228 bp, Artificial Sequence
  Synthetic oligonucleotide
gggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgccttttttttttttttttttttttttttgagatgggttctcactatattgtccaggctagagtgcag

SEQ ID NO: 6091 - DNA, 195 bp, Artificial Sequence
  Synthetic oligonucleotide
tggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaaaaaattgtc

SEQ ID NO: 6092 - DNA, 102 bp, Artificial Sequence
  Synthetic oligonucleotide
gtctagtgacggagcccgcgcgcggcgccaccatgcggcagaaggcggtatcgcttttcttgtgctacctgctgctcttcacttgcagtggggtggaggcag

SEQ ID NO: 6093 - DNA, 78 bp, Artificial Sequence
  Synthetic oligonucleotide
gtaagaaaaagtgctcggagagctcggacagcggctccgggttctggaaggccctgaccttcatggccgtcggaggag

SEQ ID NO: 6094 - DNA, 1170 bp, Artificial Sequence
  Synthetic oligonucleotide
ccttatgtctatgtagatagaagaggatatttaagagataactacttttttttctgagacgaagtcttgctctgtcacctgggctggagtgcagtggcgcgatctcaactcattgcaaccgccgcctcccaggttcaagagattctcctgcctcagcctcctgaatagctgagattacaggcatgcgccaccatgcccggctaatttttgtgtttttagtagagactgggtttcaccatgttggccaggctggtctcgaattcctcacctcccgccaggtgatctgcccgcctcggcctcccaaagtgctgagattataggcgtgagccaccgtaccaggccagagataacttcttactggtttacctttcctgttaacattttagagcaagattacacattctctgaaggaaaatgctagttacttacaggatttaagtaatagttgtatctaacacctgatctgtatcaaaatgagtctcttttcttagagtcactagtacttttcaattctgatcactttcctatgttgtattcatgaaatgaacacaagctggggaaagacattatttgctaccaagtgacaatcttttcaatcctgcaaataatagagcataggactataccaagatttctcttctgttggaagttttgacttcaacttcatattccaaactgggctgcttacttgggtgacattacataggatgactttgcccctatagttaagtgattgcacctttaaacagaagttttcatatcatggacatatttttaaatccataagatgacagatctggaagaaagacacttataaagcttcataaagccactgattctttagctttgtggttttgctttataatctacatactaaccctttcagcttattaacattcttataatcagatatacattcttaccacatcatttcctcagagttctctgttttcatgtaaaaatccaattcaacacagtatttaaaagctgctagccattttttagacaagcatcttcctgtctttttatctgttttttaaaaataatcttgccttgagatataaatgatcccagaacttttctgatatctttgtatttttatcaaaagtgttactttttctaaaatcagctaaatttttgaagtctgatgtaactattttgaatttttag

SEQ ID NO: 6095 - DNA, 444 bp, Artificial Sequence
  Synthetic oligonucleotide
aaaaccatgattatttaccaagaattggagtttctcttctgtaagcaataaagaaaaataaagttcagccacatcttcactagagaaaataaaaatgaaaacaaggaaaaacaaagttttacatgttgtttgatgcaaagagtggagaacttggataggaatggatattcactcctgaattctaaccataggctgaaatctacctccaaagagataggctgagtttgcttttggatccaagtgcaccagccatgactgtgttgaccttattcacgtggcttattacagaccagtaatggaccatttttttcagttgctggcctggcagttttgttttggagacaattttttatttctgtgcattagccctgggcacacacctggctaagtccagagttctgtgtctttttaaccttttgctggatttctctgcattttctacag

SEQ ID NO: 6096 - DNA, 194 bp, Artificial Sequence
  Synthetic oligonucleotide
aaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttag

SEQ ID NO: 6097 - DNA, 194 bp, Artificial Sequence
  Synthetic oligonucleotide
aatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctgg

SEQ ID NO: 6098 - DNA, 1014 bp, Artificial Sequence
  Synthetic oligonucleotide
tttttgagacggagtcttgctctgtcgcccaggctagagtgcagtgatatgatctcggctcactgcaacctctgcctcctgggttcaagtgattcttttgcctcagcctctcgagtagctgggattacaggcacgcaccaccatgctcagctaatttttgtatttttagtagagatggggttttgccattttggccaggctggtctcaaattcctgacctcaggtgatctggtctcaaactccgacctcaggtgatctgcctgcctaggcctcccaaagtgctggaattacaggtgtgagccaccacgcccatccagacactagtatttctaattgtttctttttcattatcttggagctttttacactctagtttcaaaatggttgaaaatatgcctttcttttataaagtgggacaagggcagttgtgaaaggggggagatgggaaaaaagccttgatggccagaggtacattcttatgaagatcaatttttggaaaaatctatatgtggaactgagtatctggaatttgattctctcttgactgacctttctcagtgtactccttgacagtgttcctgtttccccaggggcgtgcttgtcccaactgaaggccactggtataatggactctttgtagtaattggctacacctttctaaaacaagtggtcccgtttaattagctaccttagggtgaaatgaaatgtagggaacgagtctaagtctttcttgatggtagctctctcctcttatttctgcatttattaaggtataagaactctttgctctcatgtgacttaaaatcagcagctggaaatattcttgttgcaagataagtgattaagcctcaggaaaataccttgctttctaaggtctgtctggcctaaaatacccttgtagctgctgttgggttccaaacaaatggatgaggaaaaagggttaggccagattagcatgaggcagttttggggaaaagacaaacccttcttttgtatgtatgtctgtgtacccag

SEQ ID NO: 6099 - DNA, 404 bp, Artificial Sequence
  Synthetic oligonucleotide
tgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgc

SEQ ID NO: 6100 - DNA, 414 bp, Artificial Sequence
  Synthetic oligonucleotide
ctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttctt

SEQ ID NO: 6101 - DNA, 402 bp, Artificial Sequence
  Synthetic oligonucleotide
tacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgag

SEQ ID NO: 6102 - DNA, 1184 bp, Artificial Sequence
  Synthetic oligonucleotide
gaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctagcatccttctcaccacagccataacccttttttacttccattag

SEQ ID NO: 6103 - DNA, 73 bp, Artificial Sequence
  Synthetic oligonucleotide
gtaggtccctactgtctgggggaaaaagccttgtggagctggcaccttgaaacgtaactgttttgtcttgtag

SEQ ID NO: 6104 - DNA, 63 bp, Artificial Sequence
  Synthetic oligonucleotide
atgatccagatcctgatgatggatttaactataaacagatgatggttagagatgagcggaggt

SEQ ID NO: 6105 - DNA, 54 bp, Artificial Sequence
  Synthetic oligonucleotide
ttaaaatggcagacaaggatggagacctcattgccaccaaggaggagttcacag

SEQ ID NO: 6106 - DNA, 50 bp, Artificial Sequence
  Synthetic oligonucleotide
ctttcctgcaccctgaggagtatgactacatgaaagatatagtagtacag

SEQ ID NO: 6107 - DNA, 61 bp, Artificial Sequence
  Synthetic oligonucleotide
gaaacaatggaagatatagataagaatgctgatggtttcattgatctagaagagtatattg

SEQ ID NO: 6108 - DNA, 118 bp, Artificial Sequence
  Synthetic oligonucleotide
gtgacatgtacagccatgatgggaatactgatgagccagaatgggtaaagacagagcgagagcagtttgttgagtttcgggataagaaccgtgatgggaagatggacaaggaagagac

SEQ ID NO: 6109 - DNA, 82 bp, Artificial Sequence
  Synthetic oligonucleotide
caaagactggatccttccctcagactatgatcatgcagaggcagaagccaggcacctggtctatgaatcagaccaaaacaag

SEQ ID NO: 6110 - DNA, 55 bp, Artificial Sequence
  Synthetic oligonucleotide
gatggcaagcttaccaaggaggagatcgttgacaagtatgacttatttgttggca

SEQ ID NO: 6111 - DNA, 23 bp, Artificial Sequence
  Synthetic oligonucleotide
gccaggccacagattttggggag

SEQ ID NO: 6112 - DNA, 56 bp, Artificial Sequence
  Synthetic oligonucleotide
gccttagtacggcatgatgagttctgagctacggaggaaccctcatttcctcaaaa

SEQ ID NO: 6113 - DNA, 55 bp, Artificial Sequence
  Synthetic oligonucleotide
gtaatttatttttacagcttctggtttcacatgaaattgtttgcgctactgagac

SEQ ID NO: 6114 - DNA, 34 bp, Artificial Sequence
  Synthetic oligonucleotide
cccaggtgtgccaaggaattaatcttggtttcac

SEQ ID NO: 6115 - DNA, 270 bp, Artificial Sequence
  Synthetic oligonucleotide
gtgagtgaggatctgccggagggagggagacaacaaggagagaggggtgtgagatggcggggagggaacacgcacaagccaagccgtgggatgtggagggtgcgggcggggcgcggggcaggctcagctgccctcagagtctgggctggggagagccggggcccacgaggcgtggcaaggcggggagagagaagctagacctccctgctgcgcttctgcagcgaaaatggagagacccggaaggcgtgtgtgcgcccgcctctcccacag

SEQ ID NO: 6116 - DNA, 235 bp, Artificial Sequence
  Synthetic oligonucleotide
gagggagcgcggagacccgggagcggcctaggaccggaggcgcgacccctcggcccaccttgaggcccggcctaggaccggaggcgcgacccctgggcccaccttgaggcccggcctaggactggaggcgcgacccctcggcccaccttgcgggagccgcctaggaccggaggcgcgacccctcggcccagcttgaggcccggcctaggaccggaggcgcgacccctcggcccac

SEQ ID NO: 6117 - DNA, 222 bp, Artificial Sequence
  Synthetic oligonucleotide
cttgcgggagccgcctaggaccggaggcgcgacccctcggcccaccttgaggcccggcctaggaccggaggcgcgacccctgggcccaccttgaggcccggcctaggactggaggcgcgacccctcggcccaccttacgggagccgcctagggccggaggcgcgacccctcggcccagcttgaggcccggcctaggaccggaggcgcgacccctcggcccac

SEQ ID NO: 6118 - DNA, 215 bp, Artificial Sequence
  Synthetic oligonucleotide
cttgaggcccggcctaggactggaggcgcgacccctcggcccaccttgaggcccggcctaggaccggaggcgcgacccctgggcccaccttgaggcccggcctaggactggaggcgcgacccctcggcccaccttgaggcccggcctaggaccggaggcgcgacccctgggcccacctggcggcccggccggcacagcccgcctctcctctccag

SEQ ID NO: 6119 - DNA, 123 bp, Artificial Sequence
  Synthetic oligonucleotide
atggagttttgctcttgttgcccaagctggagtgcaatggtgcgatcttcgcttactgcaacctctgcttcctgggttcaagtgattcccctgcctcagcctcccgagtagcagggattacag

SEQ ID NO: 6120 - DNA, 730 bp, Artificial Sequence
  Synthetic oligonucleotide
gtgcgtgctaccatgccaggctaattttttgtatctttagtagagacaggagtttcaccatgttggccaggctagtcttaaactcctgacctcatgatctgcctggcttgacctcccaaagtgttgggattacaggcatgagccgttgcacctggccagggtgtgtcttattgaaattgaacaaaatacctaatttctagagcgtataagagaagtttaaaatgctttatggatgtgttgttttgacagcaaaatatctactcagaatcctatagctatttcaaaatccaagtaacttagaaaaaaaggaaaaagaaaacctatatagtcaaatcttttggtgattttgtattcaatgactgaaacttcccagtgattattgggctttttagctggaattgaacttgaatcggggcagagcagcacaatgcttcagaacttcagcgactctgagccctggttctgcaatgacctgccaagtagctttagtctacttgactgctctgaaccttaattttctcacctgtatgggaatcatagactctactttatgaggctgacgtaagcattacatgaaattttgtatacttatacataatgtgcttagcaccgaatacttggtgacagcagatgcccaatgagagttatcacagatattatttcagaatcgtgaagagtcagaagccaccaaattcttgatttctgtcaataaactgatattcatattctg

SEQ ID NO: 6121 - DNA, 580 bp, Artificial Sequence
  Synthetic oligonucleotide
cttcaagcgattctcctgtctcagcctcccgagtagctaggattacaggtgcacgccaccaggcctggctaatttttatatttttagtagagatgggattttgccttgttggccaggctggtctcaaactcctgacctcaggtgacccatccaccttggcctcccaaagtgctgggactacaggtgtgagccaccatgcctggtcccccacttgttgattttgcagaaaagatagctgtgttacaacctgtcctaaggtcaggtatgaatacttgtgcttctttcttggctccccaagccagagggcattcctatgcccaggtgagagagcacggagtgttactttggcagcacagtcagttaccagaggtaggaaaagcaaaggccaggcaggacatgaggggcccttgcactggctggttctccctgccttcaccaccctccaggtgaatgactgggtgaataatgattgactgaggaggtaatgaataatttatggacactgctggacctcagtctcctcatctgaaagatgagtggttggagaagtttaatggttttcaaatgctttttttttcag

SEQ ID NO: 6122 - DNA, 560 bp, Artificial Sequence
  Synthetic oligonucleotide
tcttcaaataagtgtttacgtagaagcaccatatctgaaacaggtgacagtggaccagtctgaatgaaatgagggttggcaggcctgagctccaaaaccttctgattgcccaagccctccttgtcttgcttggattatctccacacaaatggagaaactggacaaggtggtcatggaggtccctgaaagctcaaagactttctcattccaggattccccatgttcatatgccagcatggcatgggggtgctctgtagtcaagcagggtcctttggggggcttagggatggagccaggaaatggctctgggactcagcgggtgtccagagtctcatcagcagggtttctttactttcactgagtggctggtgcctgcacactgagttttgcaggcttactctcacagagtgagcttcctgcaggccccccactgcaacccctttccttcctggagctgtgtgctgactggtgcgtgagcaccccaggccctctccccatgctgctgatggtcagctttctctgcacgctcgtggttgccacagtcaacgctgataaaattg

SEQ ID NO: 6123 - DNA, 465 bp, Artificial Sequence
  Synthetic oligonucleotide
ctgattattggcatcatctccattgtcctactcggttcttaaaggcatatggacttgcctcactcctacagcaaatgacggcatgggcaaagaggggcaacagacccaccctgaagacactcctcatctggttgacttggcagggttaagggaaaaagatgtgatgactaggagctgagagcttagtggttctgccagagctgcagagtctttgttggcctcagggtgggacctctcacatctctgtcagcttttcacagacaccaacctgttatgattcatttcacctgtcctgagcactagcaagaaaaattcgctgtagcttgtgatgtattattctggatttctcaactcattcatttgttcattcattcactataccattactgtctattataaggggggcacaatggtaggtgctgggaataaaaacgatgtttaacgtttcatgaggcttccctgtcc

SEQ ID NO: 6124 - DNA, 140 bp, Artificial Sequence
  Synthetic oligonucleotide
gtacaaagcactgggaatacaaccttgaacaagacaagaatcctggccttcaaggaacttcgaaccttttgggggatatgataagacacattaggaatcaccatgttaatggttatctttcttgaaggatataagtccag

SEQ ID NO: 6125 - DNA, 305 bp, Artificial Sequence
  Synthetic oligonucleotide
gtaagtggttagagggaagctgcaaggaagagtatctaggaggtaactaggtgaagaattttcttcagggggaaagaaatccatgcataaagtcttggtgccttcaagaaattgaaagacatttagtgtggctgtaggacaggcaggaaagagaatttggaaagagcctgctggctgcagatggagatggcccctatggtttgaagttttaagctgagtctctgcaatggaaagacctttgtctttcctgtgtccggtgtgggggagtggactcttctgggtgagtcaccaccaaatgcccagag

SEQ ID NO: 6126 - DNA, 160 bp, Artificial Sequence
  Synthetic oligonucleotide
acacatatactcacagaaatgagttatttaaagaagacggtccagattccacagtccaaaaaaaaaagaggtttgccctgcttctgaaggagtcagggtatgaatgcagaggtcttcctgttggctcacatatcagatcttcaacgtcaacattaaatgc

SEQ ID NO: 6127 - DNA, 2096 bp, Artificial Sequence
  Synthetic oligonucleotide
ttcagtagaccgtccacaaatgttagccattaccctcaccactgagacccaccatttccataacaggcactgttccaggttctggggacatagggggatgaagaaagatgggtctctgccctcttggaggttatggttttatgggaagattctttttgtaatgatttcaagttaattaacttatttattagcaaatggcaaagctcccccacccctatctgcccctcttcttgcctggattgatttctcttctctctcttctaaaatccttagtaatgataaaagggcagggttctgggatgcctggaggggtaggaaataatcccagctccttctttccccttctagtgcccatgactaggctgttaccgattgactcctagcttgttattgttgctgtgtgctggtctttggggctctgtttccctggtggggtgtctatgctctttaatgcatcccaggaggatcctaagatgtgaggccatgaggaccaacgccagctccttgtctactacactctgaggctcaggcagatataagagggtcttccaatcgaatgtgatatttggcttccttagatgcttctgccttagatcagcccagagggtggctgtggtggaaggcttagcattattatttcatccccaatagtgagagggagctggggagggacaggggagggagatagaggatggataaagaggtttcccttggattagactctgtctgggagagaatcaaactaggctcgtatttcaccaatgctggacctaaaagaagaggaagtgggggaaggagggaggaagagctatctttagtacccagcccctcttccccattagtcaatgcctaagaataataatcatagccagtattatgggaggtgcttatttttgggccaagctgagtattttaaatgcatcttttcaattaattcttataataaccctttgagaaatgaagtacattatcattttattgatgagaagatgaggaacagattcggcatgtaacaggttcaaggctccacctttacaaagtggcattactgagactcaagctgagagctctcagatgccatagtgaatgctctgcactgcttacttttgcccacccacctccggcgccacccctggcagcagcactgtattccaggaatagccagaccccgccctaagagcgaatatgtcctttcgtcacctaccaagtatgggtgctttccaaaacacacttccaagtcctctccagcttttcattttcttggggcctaatttttcctttttaaattttctccagtcagagagggcacctaattcctttatttccctttactcttgtgtactggctggttgtcctccattctctttgtttacatccatcgctgcctcctttcttcccagtctttccggctctgggtttgcatccctgccctcagtgtctcccagtttccttgctttcttttatttccctcctgattgctgcctccccagttcttaccagctctctgtcccagtcctttcctgtcaaagatggcagactcctccaatgccaccgctcccctacccatctgcccggagtcttcccttctctctccctccctgctggctcttttggccatcccccttccctgcataatctttattgcttgcatgactgctcaggttctttatcccatcttcccctcaaaggcattcgcagctccgctgttattcttgtattagcattgaacccattaaagctaatttgtttgccctaatctccatttatttttccctagttgatattagatttccctttctattgctccagcatgattttctctttgtcttcctaatggtctacccccctctctcttcctctattaatctggttggcttcactgtgtggtttcaaggcctttctctgcctcccccagcccttagattaaccctgtcacctccctcccaagaagggcttcagtgtgtggatttttagggatggagctgcttcaaatgtcaatagacctctaagctccttaagaaaagtactacttgacatgaggccctgccttttcctggagccaagctggagaccttgggagcacaggggccagagag

SEQ ID NO: 6128 - DNA, 247 bp, Artificial Sequence
  Synthetic oligonucleotide
cttgaggcaagtgagacacacatgggctgctctgagcctgaaggtcaccaagtccaagggttccctgggtagggttgcctttggtgctgtctcagagatttctggaggtctcttcacgctgtcttagatcctataaattatatcagcaatataaggtatataaagtaacagcagatgagccactttctccctctgagattgggcaccatttcccaagcaggggactcacttcctttccttcctgcag

SEQ ID NO: 6129 - DNA, 321 bp, Artificial Sequence
  Synthetic oligonucleotide
gagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcag

SEQ ID NO: 6130 - DNA, 177 bp, Artificial Sequence
  Synthetic oligonucleotide
tgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaa

SEQ ID NO: 6131 - DNA, 772 bp, Artificial Sequence
  Synthetic oligonucleotide
gtcagagctcaccatgcctccctctcctacttgctcagcattttgtgtctatctagactgaagcctttgctttctctctgtgattgtggtgaaagttcagtttgctttcctatctctagaatgtcagcacgaaggcagaggcatggtctcctgagttccataaccccaaagcctaactccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttact

SEQ ID NO: 6132 - DNA, 159 bp, Artificial Sequence
  Synthetic oligonucleotide
gtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggag

SEQ ID NO: 6133 - DNA, 460 bp, Artificial Sequence
  Synthetic oligonucleotide
ctatggccacaacgtgcctatcacacaagtccagcctcacgtcagctggacaccagctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggttgatcaaatgtacaaaatatgcatgatggcaccatattgtgtataatagtgacaaatacagtctatgtgggtggagaaacaagctcggtgttgtg

SEQ ID NO: 6134 - DNA, 1579 bp, Artificial Sequence
  Synthetic oligonucleotide
cactggctgaaattaacctgacaggaacgcgtcctgtgtgattgtgtttctctcattccagacgtgcgtgtgtgtgcgtgtgtgtgtgtctctactttgggttaatgtgggaatgctttcctatatcaataagtcacaagtcgatctgtgaaaagattgtgcatacaaaatggagatgaagatcacaggggctttaataataaaataaacataaacaacactcgaatctctttataaatcccagagcacaatgtgcgttttcttacttccttttcatggaccccaaataaagactttgacagccagatatccaagatccggatcagccagcttcctaaaattctcctctttttttttaaggggtagaaaactgggggtatcccttggtggttaggggttgcttagagactgtggtagagatttggtgttaacaaaaatgtattttgaaagcaggatttcaattttcttatattgaatggcaaaggttccatgcacctggctatcttcatttctgaaatgaatgctttcattttattctctccagctaccttctccctttctttcctttccacccccattgcctcctttcagtgtctttctttttctccttattctttcactcctttctctctcacagcaaaatgttctggaggatgtgaatgattaaactgtttactccaaggtttaggtatgaaaaggcaagtcactgtaagtaaagtttcacctttatacccaactccatcaataattacagaacaaggatgactattagtaaatctttcttacaattggctcttacaaaaatgatttcattttttctgggcataccaagtttgacagattttacttttcacaaaaattatttacacagcagaggaacctgctccaaaatgaaggaagcatataaagggccgttgagtgtatccataggaaaatgaatacctataaaatgcatctcaataaattagagatttgaggccataaatagaacgttttgacgtattatattagtagatgccctctaatttaaaccaaagtgtcccttaataattaaaattccatgagattgattttttatttggtttccttcacttcctttgtcttcttcaacaaaattaggcagagtccttttgggggtagactgataaaattaattaactttccttccacccccaaaaagttccaaataaatgcttccaatagacatcaaaaaagtgtcaattagaaataactacttcttatcaatcagtggggcaattaaagtgacaaagcttaaaaagatacttatcttaaaactaattcacaaggtagctaaattatctcctaattaacttgcattgtggagggtgggggggaaccatcttgaaacaaagatgaattgatgaaccccaatacctctttatgttcctcaaagttgcttccatcccctgaaaccttattttcaacccaggcaggaaacctgggaagaaaacagatcctttccaaatgcatttattccactttcctcaattctaaaaccaagagttaggaatggggctttagatctcacatcagggaagttagagacatcgtcctctgc

SEQ ID NO: 6135 - DNA, 477 bp, Artificial Sequence
  Synthetic oligonucleotide
ctggggaaaagggggaacctgctaaaacccgagagataatgggcttgtaaaaaccagaggggtccgcttatgagtttagctccggttatagacaacagtgtcaggtaagctgatcagaaagacagacggcctctccctcaggtttgccgagggagggttcagaaaagaaacagggagcgccttcagcagtctatgcggttataggccattttcttgttttattagcgtttaaattaaactatgagaagaaagtctcatcttccctccctcgccactttgtctatttgttttggaaagagggtagaagaagcccctctgtcttcccgaaaagaagaaaggggaaaaaaattacctggtaggtccaggggcagagggctccctcccaaaacccaagcgcgatttgcatccaagctagtgggaaagcgcgcatctcatcatctgggactgttcctgattaaaactacagtaaaaataaat

SEQ ID NO: 6136 - DNA, 56 bp, Artificial Sequence
  Synthetic oligonucleotide
ggaaggggtggagctagaactggacacctcgggggtttcctgctttatggcgaagg

SEQ ID NO: 6137 - DNA, 101 bp, Artificial Sequence
  Synthetic oligonucleotide
gccagggccccacaccttccgcctgacagccagccaagctcttcagtcccccgccctccacctgccagggaggctccgggcgttgtacctgccaccacggg

SEQ ID NO: 6138 - DNA, 9 bp, Artificial Sequence
  Synthetic oligonucleotide
gtaggtctg

SEQ ID NO: 6139 - DNA, 74 bp, Artificial Sequence
  Synthetic oligonucleotide
atggagcctcgctctgtcacccaggctggagtgcagtggcacaatctcgggtcactgcaacctccgccccccag

SEQ ID NO: 6140 - DNA, 76 bp, Artificial Sequence
  Synthetic oligonucleotide
ctgatgcagattgcctgcccagctgcgagtgctggcacgggaccagcagcccagacggtcactggaagtggttggg

SEQ ID NO: 6141 - DNA, 16 bp, Artificial Sequence
  Synthetic oligonucleotide
gtgcttggggagaccc

SEQ ID NO: 6142 - DNA, 105 bp, Artificial Sequence
  Synthetic oligonucleotide
ggctgactgctggtgcctggaacctgcacaccctcctgggactctgcatctctgctggggctggtttctcctctgagccaccttaaggaatcccaccctgacccg

SEQ ID NO: 6143 - DNA, 52 bp, Artificial Sequence
  Synthetic oligonucleotide
ctgccacaaggcacctgggctcctaaatgaccaatacacatgtgctatactg

SEQ ID NO: 6144 - DNA, 164 bp, Artificial Sequence
  Synthetic oligonucleotide
cccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggag

SEQ ID NO: 6145 - DNA, 146 bp, Artificial Sequence
  Synthetic oligonucleotide
gaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcaca

SEQ ID NO: 6146 - DNA, 141 bp, Artificial Sequence
  Synthetic oligonucleotide
gtgtttatacgggagctgatctccaatgccagcgatgccttggaaaaactgcgtcacaaactggtgtctgacggccaagcactgccagaaatggagattcacttgcagaccaatgccgagaaaggcaccatcaccatccag

SEQ ID NO: 6147 - DNA, 1167 bp, Artificial Sequence
  Synthetic oligonucleotide
gtaagcgtggggcccccacacagcctcccccttcccctcagggtgcaaggatccctccagtaggggtggccctgggtgccagattaagtaagaacgttgtcagttgcatgccacgcagtgggtactgtgggaacacctcatgacatgacagccatccctcagtatctgggggttggtccctcagtatctaggggttggtttcaggaccccccttggatagcaaagtctgcagatgctccagtcccggattaaattggtgccgtatattgtagacacatcttcttgtatgctttagatggtctctaggttagttataatacctgatagaatgtaaatgctagatatagatataacatagttatgttttttatactactttttatcattgtgttgttttttattttttttctgagtattttcgatccttggctggttgaatctgcaaatgtggaacccgtagataggaggaccaactgtattggctcactgcaacctctgcctcccggttcaagcaactctcctgcctcagcctcccaagtagctgggattacaggcacgagccaccacgcctggccaattttttgtatctttagtggagacggggtttcaccatgttggccgggctatcctccagcctcagcctcctgaggcgtgactacaggtgcacgtcactatgcccagacccacagagcagttctgaccagaaccatcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcgggtggatcacgaggtcaggagatggagaccatcctggctagcacggtgaaaccccgtctctactgaagatacagaaattggctgggcgtggtggtggtacctgtcatcccagctactcgggaggctgaggcgggagaatcgcttgaacccgggag

SEQ ID NO: 6148 - DNA, 893 bp, Artificial Sequence
  Synthetic oligonucleotide
gcagaggttgcagtgagctgagatcacgccaccgcactccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacag

SEQ ID NO: 6149 - DNA, 857 bp, Artificial Sequence
  Synthetic oligonucleotide
tgttgttcccatgctctggattattgaaatacattgtaatttacctgcttaaaggaaagactaaatattaagaagaaaataaaaatatccctagtcccagtgataaagttgttcctaattttaggccattatgtaatgctgcagtaaatatcctgatccctaaaatcccaattttgaaaaattagagtatacatatattcagtataaatcccaaattacagtgtacatatatagtatatacagtgctgctcctaatgatggaaaattgttatgtacatgtagaatgtgcattctttgcctgtatctatagacgtactgtaatttacccacattgggatttttctgggttttctttcaacacagctaactttctcatgtcattgaggattattaaaagatgcagttttttttttttatggccatttagcattacataattttagcctatattcttgaacatgaggttgttcataattgttatattttatgtgccacagtgaaaatcctggtacataaatcttggtgtgctcacatgtttcctaaggtgcagttcctataattggaacaactggctcaaaggttggaagggttttccgggcgtgggtatcttgtctctgggggcatcggttctcctactgcctccagggggtgtctgccctccaccctgctgcctcctgtccggccactgcccagggtttctgtctttctgctcagtctttttcagtttggccaataacggtaccttgttgttttcacttctttgattcttagcggggctgaacattttttcgtaccctctggccatttgtatttcatagaggctgcttgtatgtattaaatgcatttcttttctgtag

SEQ ID NO: 6150 - DNA, 121 bp, Artificial Sequence
  Synthetic oligonucleotide
gctgatcaaattcttcattgaccagagtaaaaaagatgctgagaagtatgcaaagttttttgaagattacggcctgttcatgcgggagggcattgtgaccgccaccgagcaggaggtcaag

SEQ ID NO: 6151 - DNA, 186 bp, Artificial Sequence
  Synthetic oligonucleotide
gaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagag

SEQ ID NO: 6152 - DNA, 120 bp, Artificial Sequence
  Synthetic oligonucleotide
atatacgagaacgccatgattgctgctggacttgttgacgaccctagggccatggtgggccgcttgaatgagctgcttgtcaaggccctggagcgacactgacagccagggggccagaag

SEQ ID NO: 6153 - DNA, 4 bp, Artificial Sequence
  Synthetic oligonucleotide
gaga

SEQ ID NO: 6154 - DNA, 9 bp, Artificial Sequence
  Synthetic oligonucleotide
gcgtgcagg

SEQ ID NO: 6155 - DNA, 7 bp, Artificial Sequence
  Synthetic oligonucleotide
gttccac

SEQ ID NO: 6156 - DNA, 20 bp, Artificial Sequence
  Synthetic oligonucleotide
ttccaaacatgagttccagg

SEQ ID NO: 6157 - DNA, 56 bp, Artificial Sequence
  Synthetic oligonucleotide
ccgagacaaagaagcttttggacattgttgcccggtccctgtactcagaaaaagag

SEQ ID NO: 6158 - DNA, 72 bp, Artificial Sequence
  Synthetic oligonucleotide
gatactggtatcgggatgacacaggaagagctggtgtccaacctggggacgattgccagatcggggtcaaag

SEQ ID NO: 6159 - DNA, 105 bp, Artificial Sequence
  Synthetic oligonucleotide
gccttcctggatgctctgcagaaccaggctgaggccagcagcaagatcatcggccagtttggagtgggtttctactcagctttcatggtggctgacagagtggag

SEQ ID NO: 6160 - DNA, 56 bp, Artificial Sequence
  Synthetic oligonucleotide
gtctattcccgctcggcagccccggggagcctgggttaccagtggctttcagatgg

SEQ ID NO: 6161 - DNA, 110 bp, Artificial Sequence
  Synthetic oligonucleotide
ttctggagtgtttgaaatcgccgaagcttcgggagttagaaccgggacaaaaatcatcatccacctgaaatccgactgcaaggagttttccagcgaggcccgggtgcgag

SEQ ID NO: 6162 - DNA, 74 bp, Artificial Sequence
  Synthetic oligonucleotide
atgtggtaacgaagtacagcaacttcgtcagcttccccttgtacttgaatggaaggcggatgaacaccttgcag

SEQ ID NO: 6163 - DNA, 103 bp, Artificial Sequence
  Synthetic oligonucleotide
gagcctgtccagggccaggcgctgcactggctcaggcctgcacggtggtggagaagacgtgcgtggtgaacacgacgccctccccgccgatctccgtttccag

SEQ ID NO: 6164 - DNA, 31 bp, Artificial Sequence
  Synthetic oligonucleotide
gccatctggatgatggaccccaaggatgtcc

SEQ ID NO: 6165 - DNA, 32 bp, Artificial Sequence
  Synthetic oligonucleotide
gtgagtggcaacatgaggagttctaccgctac

SEQ ID NO: 6166 - DNA, 30 bp, Artificial Sequence
  Synthetic oligonucleotide
gtcgcgcaggctcacgacaagccccgctac

SEQ ID NO: 6167 - DNA, 47 bp, Artificial Sequence
  Synthetic oligonucleotide
accctgcactataagacggacgcaccgctcaacatccgcagcatctt

SEQ ID NO: 6168 - DNA, 16 bp, Artificial Sequence
  Synthetic oligonucleotide
ctacgtgcccgacatg

SEQ ID NO: 6169 - DNA, 50 bp, Artificial Sequence
  Synthetic oligonucleotide
aaaccgtccatgtttgatgtgagccgggagctgggctccagcgttgcact

SEQ ID NO: 6170 - DNA, 36 bp, Artificial Sequence
  Synthetic oligonucleotide
gtacagccgcaaagtcctcatccagaccaaggccac

SEQ ID NO: 6171 - DNA, 16 bp, Artificial Sequence
  Synthetic oligonucleotide
ggacatcctgcccaag

SEQ ID NO: 6172 - DNA, 19 bp, Artificial Sequence
  Synthetic oligonucleotide
tggctgcgcttcatccgag

SEQ ID NO: 6173 - DNA, 26 bp, Artificial Sequence
  Synthetic oligonucleotide
gtgtggtggacagtgaggacattccc

SEQ ID NO: 6174 - DNA, 44 bp, Artificial Sequence
  Synthetic oligonucleotide
ctgaacctcagccgggagctgctgcaggagagcgcactcatcag

SEQ ID NO: 6175 - DNA, 27 bp, Artificial Sequence
  Synthetic oligonucleotide
gaaactccgggacgttttacagcagag

SEQ ID NO: 6176 - DNA, 96 bp, Artificial Sequence
  Synthetic oligonucleotide
gttctcttctgctttgagcagtttgatgagctcaccctgctgcaccttcgtgagtttgacaagaagaagctgatctctgtggagacggacatagtc

SEQ ID NO: 6177 - DNA, 15 bp, Artificial Sequence
  Synthetic oligonucleotide
gtggatcactacaag

SEQ ID NO: 6178 - DNA, 15 bp, Artificial Sequence
  Synthetic oligonucleotide
gaggagaagtttgag

SEQ ID NO: 6179 - DNA, 13 bp, Artificial Sequence
  Synthetic oligonucleotide
gacaggtccccag

SEQ ID NO: 6180 - DNA, 86 bp, Artificial Sequence
  Synthetic oligonucleotide
ccgccgagtgcctatcagagaaggagacggaggagctcatggcctggatgagaaatgtgctggggtcgcgtgtcaccaacgtgaag

SEQ ID NO: 6181 - DNA, 34 bp, Artificial Sequence
  Synthetic oligonucleotide
gtgaccctccgactggacacccaccctgccatgg

SEQ ID NO: 6182 - DNA, 6 bp, Artificial Sequence
  Synthetic oligonucleotide
tcaccg

SEQ ID NO: 6183 - DNA, 29 bp, Artificial Sequence
  Synthetic oligonucleotide
tgctggagatgggggctgcccgccacttc

SEQ ID NO: 6184 - DNA, 15 bp, Artificial Sequence
  Synthetic oligonucleotide
ctgcgcatgcagcag

SEQ ID NO: 6185 - DNA, 15 bp, Artificial Sequence
  Synthetic oligonucleotide
ctggccaagacccag

SEQ ID NO: 6186 - DNA, 47 bp, Artificial Sequence
  Synthetic oligonucleotide
gaggagcgcgcacagctcctgcagcccacgctggagatcaaccccag

SEQ ID NO: 6187 - DNA, 49 bp, Artificial Sequence
  Synthetic oligonucleotide
gcacgcgctcatcaagaagctgaatcagctgcgcgcaagcgagcctggc

SEQ ID NO: 6188 - DNA, 9 bp, Artificial Sequence
  Synthetic oligonucleotide
ctggctcag

SEQ ID NO: 6189 - DNA, 15 bp, Artificial Sequence
  Synthetic oligonucleotide
ctgctggtggatcag

SEQ ID NO: 6190 - DNA, 58 bp, Artificial Sequence
  Synthetic oligonucleotide
gactgacaccacagatgacagccccacctccttgagctttatttacctaaatttaaag

SEQ ID NO: 6191 - DNA, 17 bp, Artificial Sequence
  Synthetic oligonucleotide
gtatttcttaacccgaa

SEQ ID NO: 6192 - DNA, 314 bp, Artificial Sequence
  Synthetic oligonucleotide
tgcagtcccaggggagggagtcagagctagaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttct

SEQ ID NO: 6193 - DNA, 182 bp, Artificial Sequence
  Synthetic oligonucleotide
gctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacag

SEQ ID NO: 6194 - DNA, 1054 bp, Artificial Sequence
  Synthetic oligonucleotide
gtttgcagatttcttttgaaattcctttttcccccctccctctgcctcagcaaaagaaaagaatccatataacaggttcatgttcaattgcttggcttttcagcacttattctgaagactttataatatttttaaacttgaccttggaacacagagggctttgtgggtgaggtgtatttatatttacttaagggtgcacattttaaaaatcttattctgtgtttgtacaaagacgcaaattttcatagtgcctagaaatagcacagatctattctactcaagattatttgtattttttcagggtattctacctagagcctgtggttaatcgcctccctgctccccctaccttttattccctaccccctcagggaatttggatacatgtgaggaatagtcctttgtttttcttatgaacctagaaaattacagatcataaaatctggatattaaagtagtttccaaaagcatctcatgggaaatcaaagtgctcggcatttccgagctggagaataaaatcaagaatccttaagagagaaaagaaaatggagatggaaatatgaattttaactgggaaaaataattggaaagctaaccttttcaaatactctaattatgaaagttggaaaaggttgtgatgctcaggattatcctgtaatgtgtgaagatacataaattagcacctaatttataggcaaattttggtaaaacacaaaaaattatggtatgtctaagttcatgaaaagtatgtaaatgcagtgggcctagaaacctggccacactgaaatacagtttaatgtggaaacttttctaaatacatattgtagcatctttggacatcaacgtgtggcctgaaatttttattattgttccctcttctcctccattaaaaaaaaaatctccttgtggtatttagtcatttaccattaacacatattatggcttaaaaagggccatcccttccttttctgagctggagttcttcacgctcacctttgatgcatggccttagctgtttactttgccttgttttgttcatgaacattgggtttag

SEQ ID NO: 6195 - DNA, 203 bp, Artificial Sequence
  Synthetic oligonucleotide
tgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcag

SEQ ID NO: 6196 - DNA, 434 bp, Artificial Sequence
  Synthetic oligonucleotide
gaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcag

SEQ ID NO: 6197 - DNA, 123 bp, Artificial Sequence
  Synthetic oligonucleotide
tcccacccgctgtacctgtgcaatgccagtgatgacgacaatctggagcctggattcatcagcatcgtcaagctggagagtcctcgacgggccccccgcccctgcctgtcactggctagcaag

SEQ ID NO: 6198 - DNA, 132 bp, Artificial Sequence
  Synthetic oligonucleotide
ctgcagcagccgctggggctgacctggccagtggtgttgatctggggtaatgacgctgagaagctgatggagtttgtgtacaagaaccaaaaggcccatgtgaggattgagctgaaggagcccccggcctgg

SEQ ID NO: 6199 - DNA, 162 bp, Artificial Sequence
  Synthetic oligonucleotide
gatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcag

SEQ ID NO: 6200 - DNA, 1356 bp, Artificial Sequence
  Synthetic oligonucleotide
agggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggaatgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctg

SEQ ID NO: 6201 - DNA, 359 bp, Artificial Sequence
  Synthetic oligonucleotide
gctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctag

SEQ ID NO: 6202 - DNA, 153 bp, Artificial Sequence
  Synthetic oligonucleotide
ctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccag

SEQ ID NO: 6203 - DNA, 455 bp, Artificial Sequence
  Synthetic oligonucleotide
ctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagagg

SEQ ID NO: 6204 - DNA, 289 bp, Artificial Sequence
  Synthetic oligonucleotide
agcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 6205 - DNA, 86 bp, Artificial Sequence
  Synthetic oligonucleotide
gtaagtgtttaatttagttctaggggacagcatctctcatcccggagtaaatttctgcctttgacctgcatggattattttttcag

SEQ ID NO: 6206 - DNA, 36 bp, Artificial Sequence
  Synthetic oligonucleotide
gctcggatggcgggtgagcgaggagccagtgctgtc

SEQ ID NO: 6207 - DNA, 39 bp, Artificial Sequence
  Synthetic oligonucleotide
ctctttgacatcactgaggatcgagctgctgctgagcag

SEQ ID NO: 6208 - DNA, 105 bp, Artificial Sequence
  Synthetic oligonucleotide
ccagattatgatgtgtggatcctaatgacagtggtgggcaccatctttgtgatcatcctggcttcggtgctgcgcatccggtgccgcccccgccacagcaggccg

SEQ ID NO: 6209 - DNA, 103 bp, Artificial Sequence
  Synthetic oligonucleotide
gagctacgggtcatttcctgcctccatgagttccatcgtaactgtgtggacccctggttacatcagcatcggacttgccccctctgcatgttcaacatcacag

SEQ ID NO: 6210 - DNA, 55 bp, Artificial Sequence
  Synthetic oligonucleotide
cccagctccccagtataagccatacaggccagggacccacaggagagtggattag

SEQ ID NO: 6211 - DNA, 216 bp, Artificial Sequence
  Synthetic oligonucleotide
ggggttaaacagagcccgtcttcaaggaaaggcagtttattgatttagttgttgatttagttattgatttagttatgaagctgtggattataaaaaggctggtttgaaagaaggaagccacattctgtgggggcctatgactgacacccctggggagagttgggccaaggctagctggcctgtgagcctcagcagcactgcagggggcctgggagg

SEQ ID NO: 6212 - DNA, 175 bp, Artificial Sequence
  Synthetic oligonucleotide
cttcagatgccagtcccaagtacagctgtccctttgtatccttgggggatgggatccagtacctccaaaacaccagaatccacaaggccagagtccctgatacaaaatggcatgttatttgcatataaccccctcctctggacttaaatcacctcttgattacttataacacctg

SEQ ID NO: 6213 - DNA, 167 bp, Artificial Sequence
  Synthetic oligonucleotide
aaggacaagtgaaaagccccagaatggcccctgcaaacagtaacagtaactaacagtcaaatgtctctgccccaggcaggttagggacgagacagaatgagggtggggagcggggctcggggagcagaggccacggtctccatgctctgctcctctggccgcagcag

SEQ ID NO: 6214 - DNA, 995 bp, Artificial Sequence
  Synthetic oligonucleotide
gctgcaggcacctgccactactgcagaggactgaggggccttggcccagcagggaccccagggccttgggggactgtgtgagctggaaacgtggctggccagatgggcagcaccatggagccccctgggggtgcgtacctgcacctgggcgccgtgacatcccctgtgggcacagcccgcgtgctgcagctggcctttggctgcactaccttcagcctggtggctcaccggggtggctttgcgggcgtccagggcaccttctgcatgccgcctggggcttctgcttcgccgtctctgcgctggtggtggcctgtgagttcacacggctccacggctgcctgcggctctcctggggcaacttcaccgccgccttcgccatgctggccaccctgctatgcgcgacggctgcggtcctgtatccgctgtactttgcccggcgggagtgtccccccgagcccgccggctgtgctgccagggacttccgcctggcagccagtgtcttcgccgggctcctcttcctggcctacgctgtggaggtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcc

SEQ ID NO: 6215 - DNA, 770 bp, Artificial Sequence
  Synthetic oligonucleotide
gtgaaccaaagtgtcaagtagcgagcaggagggaagccgcgggctcaggggagatgaagtacaacgggagaggtcgctccccgacttccagactgggctcagagggacaagggcaggacagtagggcagaggccctgagcagacgcaggggagagcctcacctaggccaatccccaactcactctctctcaccatttcccagcgctcctggggctcagtgctggtcactggaacatcataagggaaaactttaaagcagctgctgttgtgacccattttgcagctggggacatggaggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaag

SEQ ID NO: 6216 - DNA, 335 bp, Artificial Sequence
  Synthetic oligonucleotide
cagcttcagcagtgcccggcgggcatctgtgcactgtgggcatctgtggcactgggagggagcccggctgagggcggccgctggacacagaatctgggtactgcttgcctctgctcaagggtccagttgccgaaactcctgacgccggggccatcatcctccaggctccagccagcttctcctgcacagaagcccagcctggtccagccaggagctgacccactggccacccctgagtccaagccgggtgggcagtggcacaacagcccctcagcccattgactgggccccattgacgtccttgagcaggaaataaatgctgacatttatacgta

SEQ ID NO: 6217 - DNA, 210 bp, Artificial Sequence
  Synthetic oligonucleotide
gtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaa

SEQ ID NO: 6218 - DNA, 135 bp, Artificial Sequence
  Synthetic oligonucleotide
aagatgggggtgaagttgacaccccacaacaaggagacggtgcagcacagtgatgtgctcttcctggctgtgaagccacacatcatccccttcatcctggatgaaataggcgccgacattgaggacagacacatt

SEQ ID NO: 6219 - DNA, 189 bp, Artificial Sequence
  Synthetic oligonucleotide
gtagcaccgcaggcccagtggggtgtggagaggggctgtctagagcccgggccctcagtacttcagttttcatctgcaaaagggttgcagcgtcccggcccactgggagagctcgggcactgcttggtggggtgagtgcatctaggcactgcgtccatggccagacggacacgctggtttctcttccag

SEQ ID NO: 6220 - DNA, 222 bp, Artificial Sequence
  Synthetic oligonucleotide
aagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctac

SEQ ID NO: 6221 - DNA, 161 bp, Artificial Sequence
  Synthetic oligonucleotide
gtcagtgtgtttcctgaccctctggtggggccactctttgcggggccctggggcttcactgggaggagccaagtggggcgtcagtgtgtgctacagtggctggggcagtgccccgcagaggcaggtgcgtgcccacagccgtcagcctttcttctggctgc

SEQ ID NO: 6222 - DNA, 164 bp, Artificial Sequence
  Synthetic oligonucleotide
ggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacg

SEQ ID NO: 6223 - DNA, 641 bp, Artificial Sequence
  Synthetic oligonucleotide
gtgggcccccgcgctgcccgcttccctggtctccagtccttgcatggcagaggcctctctcacacacatctgctcattcacgcactcagcagatacgtattgagctccagcccagtgttgcgcaggacacagggggccccgaggttccctgggttactgtgggcagtgcccctccccaccttccgtttcctgcgaggagggaacatccatagagggacccggatgctgtgccctgtgctccccacataggttcaccattgtcatagctaggagtgtcatttgagccaggggccacaccagtggggtggcggggtggccagccacattaggaaacttctgtgggggcccaccttcctcctgccctcgctgtgggattaagttagaccagtaggacacgcagcaacatccaggcacaaggaaaattccatggaaggtgaaagaagcaaagagcaagagaaagacagagtttgctgtttgcctgggatcccacagctggtcaaaggcagagccaggctgggagccgctgtccccagttcaggtctgcagggtgggtgaggacgtctttctcgccacactgcccactctccagtccagacaccctcagactctgcgagtgccaccctgtaacagtgaggggaaca

SEQ ID NO: 6224 - DNA, 132 bp, Artificial Sequence
  Synthetic oligonucleotide
cctggccccagcgggcaaggattgacacgtcctgcctgaccaccatcctgccaccaccttctcttctcttgtcactagggggactagggggtccccaaagtggcccactttctgtggctctgatcagcgcag

SEQ ID NO: 6225 - DNA, 431 bp, Artificial Sequence
  Synthetic oligonucleotide
ctgtgtgggagggtggttactgtgggtggaatagtggaggccttcaactgattagacaaggcccgcccacatcttggagggcatctgccttactgattaaaatgtcaatgtaatctaatgcaaaagtctacagattcaaatgttagtctcatgcaacccctccccacccctgccagaaacagaataatgtttgaccaaacactcaggcaccctgtagcccagtcaagtggacacatacaatcacccattccaggaggcccacaggattggaggagctgctgagggttgggttacaagggccaggggtgctctggttccttcaaccaacacatagttactgagtatggagacagcaagatgaggcccccttccctccagaggcagtgcacactgtgtgaggggagctgggctgggtagcagcagggtgtcag

SEQ ID NO: 6226 - DNA, 245 bp, Artificial Sequence
  Synthetic oligonucleotide
ggtgtgcaggggggtcccaggtgcgccaggagtcagggtatgcagggggctccagggtgtgcaggggttaggagagctgagcaactttctggaacttatcccgggaactcatttccagagaccccataggctcactgcagaaccatgcttggtatatatggggcgtgtagagggcgcttggggaacagaatcctgcgtttcccccgagggagggaagacatgcaggggaacagggaggaaacgct

SEQ ID NO: 6227 - DNA, 78 bp, Artificial Sequence
  Synthetic oligonucleotide
aaccctgtgaaccccaggcaatgacagcaggatcctgaagcccatgcaggctctgaaccacgcggccatccagaaggg

SEQ ID NO: 6228 - DNA, 98 bp, Artificial Sequence
  Synthetic oligonucleotide
cagaggattcgcttcgtgcccagcctgtagcccacagtggcagcccacccacctctgctctctggccaccagctccaggctctgcgagggaaactcag

SEQ ID NO: 6229 - DNA, 66 bp, Artificial Sequence
  Synthetic oligonucleotide
gattcgctggcgcgacgggggcggggcctgggtgcgggtgccgcgtggcggccgcagcgctgaggg

SEQ ID NO: 6230 - DNA, 4 bp, Artificial Sequence
  Synthetic oligonucleotide
gtgg

SEQ ID NO: 6231 - DNA, 16 bp, Artificial Sequence
  Synthetic oligonucleotide
gtacgacccgcgcacg

SEQ ID NO: 6232 - DNA, 49 bp, Artificial Sequence
  Synthetic oligonucleotide
gtagctgggttggggtcgggctccgggaatggtgggcggcggtcgccgg

SEQ ID NO: 6233 - DNA, 13 bp, Artificial Sequence
  Synthetic oligonucleotide
gtggggcgcgacg

SEQ ID NO: 6234 - DNA, 108 bp, Artificial Sequence
  Synthetic oligonucleotide
gttagaccagctgggaccaggggaggtgggcacccggctgcgggaggagcggccaggctggcactgcccccctaacttgctctcgatcctgccggtctcgtcccgcag

SEQ ID NO: 6235 - DNA, 32 bp, Artificial Sequence
  Synthetic oligonucleotide
agccggtgccatctgtgggggctttgggccag

SEQ ID NO: 6236 - DNA, 82 bp, Artificial Sequence
  Synthetic oligonucleotide
gggtctccggacagcatgagcgtgggcttcatcggcgctggccagctggcttttgccctggccaagggcttcacagcagcag

SEQ ID NO: 6237 - DNA, 71 bp, Artificial Sequence
  Synthetic oligonucleotide
gcgtcttggctgcccacaagataatggctagctccccagacatggacctggccacagtttctgctctcagg

SEQ ID NO: 6238 - DNA, 26 bp, Artificial Sequence
  Synthetic oligonucleotide
gtggtgtcctgcgcggccggcgtcac

SEQ ID NO: 6239 - DNA, 19 bp, Artificial Sequence
  Synthetic oligonucleotide
catcagctccattgagaag

SEQ ID NO: 6240 - DNA, 93 bp, Artificial Sequence
  Synthetic oligonucleotide
gcattcacagccctggatgccctggctgatgggggtgtgaagatgggacttccaaggcgcctggcagtccgcctcggggcccaggccctcctg

SEQ ID NO: 6241 - DNA, 70 bp, Artificial Sequence
  Synthetic oligonucleotide
ggagctgcagtccatggctgaccaggagcaggtgtcaccagccgccatcaagaagaccatcctggacaag

SEQ ID NO: 6242 - DNA, 68 bp, Artificial Sequence
  Synthetic oligonucleotide
gtgaagctggactcccctgcagggaccgctctgtcgccttctggccacaccaagctgctcccccgcag

SEQ ID NO: 6243 - DNA, 8 bp, Artificial Sequence
  Synthetic oligonucleotide
gggccagc

SEQ ID NO: 6244 - DNA, 26 bp, Artificial Sequence
  Synthetic oligonucleotide
cagggacatagccagggaggggccac

SEQ ID NO: 6245 - DNA, 80 bp, Artificial Sequence
  Synthetic oligonucleotide
atcacttcccactggaaatctctgtggtctgcaagtgcttcccagcccagaacaggggtggattccccaacctcaacctc

SEQ ID NO: 6246 - DNA, 9 bp, Artificial Sequence
  Synthetic oligonucleotide
ctttcttct

SEQ ID NO: 6247 - DNA, 6 bp, Artificial Sequence
  Synthetic oligonucleotide
ctgctc

SEQ ID NO: 6248 - DNA, 14 bp, Artificial Sequence
  Synthetic oligonucleotide
ccaaaccatgtcag

SEQ ID NO: 6249 - DNA, 6 bp, Artificial Sequence
  Synthetic oligonucleotide
gaccac

SEQ ID NO: 6250 - DNA, 4 bp, Artificial Sequence
  Synthetic oligonucleotide
cttc

SEQ ID NO: 6251 - DNA, 53 bp, Artificial Sequence
  Synthetic oligonucleotide
ctctagagctcgggagcccggagggtcttcacccactcctactccagtatcag

SEQ ID NO: 6252 - DNA, 13 bp, Artificial Sequence
  Synthetic oligonucleotide
ctggcacgggctc

SEQ ID NO: 6253 - DNA, 4 bp, Artificial Sequence
  Synthetic oligonucleotide
cttc

SEQ ID NO: 6254 - DNA, 53 bp, Artificial Sequence
  Synthetic oligonucleotide
ctgagagcaaaggtcaaggaccccctctgtgaaggctcagcagaggtgggatc

SEQ ID NO: 6255 - DNA, 12 bp, Artificial Sequence
  Synthetic oligonucleotide
ccacgccccctc

SEQ ID NO: 6256 - DNA, 11 bp, Artificial Sequence
  Synthetic oligonucleotide
ccggcccctcc

SEQ ID NO: 6257 - DNA, 4 bp, Artificial Sequence
  Synthetic oligonucleotide
ctgc

SEQ ID NO: 6258 - DNA, 24 bp, Artificial Sequence
  Synthetic oligonucleotide
cctccattcagggagaaacctctc

SEQ ID NO: 6259 - DNA, 58 bp, Artificial Sequence
  Synthetic oligonucleotide
cttcccgtgtgagaagggccagagggtccaggcatcccaagtccagcgtgaagggcca

SEQ ID NO: 6260 - DNA, 21 bp, Artificial Sequence
  Synthetic oligonucleotide
cagcccctcttggctgccaag

SEQ ID NO: 6261 - DNA, 65 bp, Artificial Sequence
  Synthetic oligonucleotide
cacgcagatcccatggacatttggggaaagggctccttgggctgctggtgaacttctgtggccac

SEQ ID NO: 6262 - DNA, 6 bp, Artificial Sequence
  Synthetic oligonucleotide
cacctc

SEQ ID NO: 6263 - DNA, 45 bp, Artificial Sequence
  Synthetic oligonucleotide
ctgctcctgacctccctgggagggtgctatcagttctgtcctggc

SEQ ID NO: 6264 - DNA, 6 bp, Artificial Sequence
  Synthetic oligonucleotide
cctttc

SEQ ID NO: 6265 - DNA, 33 bp, Artificial Sequence
  Synthetic oligonucleotide
agttttataagttggtttccagcccccagtgtc

SEQ ID NO: 6266 - DNA, 33 bp, Artificial Sequence
  Synthetic oligonucleotide
ctgacttctgtctgccacatgaggagggaggcc

SEQ ID NO: 6267 - DNA, 4 bp, Artificial Sequence
  Synthetic oligonucleotide
ctgc

SEQ ID NO: 6268 - DNA, 789 bp, Artificial Sequence
  Synthetic oligonucleotide
aagtccccttaacctctttctgcctcagtcgactcacctggaaaacagagcacctacctccttcaaatgagaagagaagtaaaggagtataaggccatcagaacagtacctggcccaagggaggctatggaagtgcttgttgaataaaaaaatggcttcatctctggcctagccccaaaggtttgagttcctgccattgccacccagacagccctgggtggaggccctgctgacattgaagagtgcctgccctcctcccctcaatgcggtagacactttccaaaacttacgtcatcctcactctcactccagtgggataatgggaggcttggtgtacctcattcccaagatgagggaacaggctctgagaggaccacatcgccagcaagtgacaggctgggaccaaggccaggcctgtctgcctcctagactaggcctgagtgaggaccggcctgagtatggcccacctgcttcctcctccgtttagagcttgggctggagctgtcctggccagtgctctctgcctcaccaggctgcatgagccacaagctgccacttgtggagctcggtggccctgccctcgacagccttgctggtggtcgtgaaggctctaaacacctgcatggcaatgaggccaaccttctccgcttgatccgtttcaggctctggctccgctactgcatcgtgtgcttctgtccaagaggcagagagactgaaactatctgctgccgcctggattctcccagagattgcctggaacaccagctcgggtcctcgcacaccatcctg

SEQ ID NO: 6269 - DNA, 248 bp, Artificial Sequence
  Synthetic oligonucleotide
gtaggaatctctcagtgacaattgagagtttgtgggctggcttagggccagtggtgggcagggagtcagcagggcgcaagggactggagagcttggcatttctccaacaggagtttcagggagagctcagaggcctgcttatgtgacaggtttatcagcttgcctggcccagggccggctctcataccgttttgatttaaataatagattgctcacagaataaatgtatgttggtttaagctttcact

SEQ ID NO: 6270 - DNA, 394 bp, Artificial Sequence
  Synthetic oligonucleotide
gcagtggggagagggcagggtgctaggctctgtcatcctgtggggctgggcccctgagacaaggcagaggacagcaggatgtcttagccccttgaccatccacggacccccaacccctgctggagcagtgcttgcacccccttctcccctggcacctgccagctggacccaacagcctctcctcccactccagtgcagccagcattgtcctggggccaccttggcaccacaggtttcctccctggcaaacctgcatgacggccttgcgtgccctcccccagggccaaggcgctgttgctgaactgaagtggcaacctacccggtcagagctttaagctgcagctctgatgccccagggacctctcagacccccctgcccagagcaggcagcccg

SEQ ID NO: 6271 - DNA, 1856 bp, Artificial Sequence
  Synthetic oligonucleotide
gtaagccctcctcctcttcccctgcagcctcagggctggagccacagctgggagggctcccagatcctgaccatatcctcccagaggctgagccaggcctgggcactgtcccctcaaatgtgagaatactgggcagggggaggggagaaaggagggaatggagggctgagcctggaggcatgaaaggggcaacctaggcagcggtatgggggagtgctcagagcttagagtcctgtggaaggcagagaactgccccagcccctgcctctcatcccccaccctctgtgtccctggccgagaggttcctggaggacatttttccagcaaaagagggagggtggtgtctgggcctagatccttggatgggcttttctctgcctgcttgtggggtgcctagggcgagtgggcttttggagacaatttctggcctaacctgacttggacagcagcccccagaggcacagctctcccctcaggcatgggggcatgattccacctcgctagcccacatgtgttcttcacggagggctgctggcccgtctccctggggttaccctgagcagcagagctgtgtttgttgagactccatggggtggagggattgcgatgttgtcctctcagttcccggggctgatgtggaagctcaagggcttgccctggattcttcagggtagccctgccatccctagtgagtcagtgagttgggaggttgggggctggagaatcaggtagggaggacacagctagacctcaggccctgatgggaacgtactaggctccaagtgggacctgccaggagacaagaattgatgacagccacacctttggagtctcaagccctctgccacccatgcggtggcctagttcaaatgacaggaacacaaggtccagctggcccaatgggcaggtagagggctgcagccagggctggaactggccttgcactgcctctgggcccttctctacccacccagtagtattgttcaagcccaggagggaaaaaggccagctcagggttaatgttacctcagcaagtagctgagtggcactgagcctcctggtagccactgtaaagaaggacacagaatggtttgggggcattcgctaggaggaaggaagcagatggatactctatggagacagaatgtcctctgtgtttgctctacaggaacgggttgtcaaccttctgcagggccaggaattgtcatgaggctgtagtaggcagcagagcttggcggggtgaggcgagatcacaggtataggctcagggcctggattcaaatcccctgggctgccacttgttggatgtgtaaccataggcagagtaaggacctgccatagcaaattaccacaaactcagtggcttaaagcaacagaatagttctggaggctaaaagtctgaaatccaagtataggccaagccacactccctttgaggactccaggggaagatccttccttgtctcttcagcttctggtggctcctggcaatccttggccttccttggctgctgctgcatcactccagtctctgaaaccatctaccctatgtgtctgtgtggccttcacatggcattccttatttttgcagtggggtctcactatgttgcccaggctggtcttgaactcctgggtccaagcagtcctcctgcttcagcctcccaagtagctgggattatgagtgagtgccaccatgcccggctcacatggcctccttgtaataacgctagtgcctgggtgcggtggctcacgcctgtaatcccagcacttttggaggctgcggtggacggaccatgaggtcaggaaattgaggccatcctgtccaacatggtgaaaccctgtctctactaaaatac

SEQ ID NO: 6272 - DNA, 965 bp, Artificial Sequence
  Synthetic oligonucleotide
gtaagcccatcagggtcccaaggaagggggtctgggtttgaggccaaccatggcagctgacctactttctagcctcagtttcccctagtgtgtgcagctctcacgctgtttgggtgagaaccaggcctctgggcttggacattctttcagtgagtttttagggtggagggatgggaaatggaagcccaggacctcagcagggtgtcttcctccgatccggggacatctgcctgtgggaggctgggcccaccctcccttgctgacctgccctgggaggaagggacagggcccagcactgcctactcccctccctgttcttcccagcagtctgagcctggctgggtgtcccctgctcctccagcagcctacttgggcctttgggtagacagattaacagacaggcgaggctgggtcatggttggaccaccccaggaccctgaccgggggctcagctcatgaccctgagcctgggagagatgaggccatgccctccagggcactcagcatgacccggcccagtggacgggactgggtagcttccttggtgcagggggctgtcatgctaggacggggtcactgaccaggccaggcccctgccccatgacttgtggtggaaatgtccttttgtttttgtttttttgcattttttttgagacggagtttcactcttgttgcccaggctggagtgcagtggtgcaatcttgcctcactgcaacctccacctcctgggttcaagcaattctcctgcctcagctcctgagtagctgggattacaggcacctgccaccatgcctggctaatttttgtatttttagtggagatgggggtttcaccatgttggccaggctgttctcaaactcttcacctcaggtgatccacctgcctctgcctcccaaagtgctgggattataggtgtgagccactgcacccggccatgtgatgggaatgttctgtgtccataatag

SEQ ID NO: 6273 - DNA, 242 bp, Artificial Sequence
  Synthetic oligonucleotide
atgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaacggggcagggaggaggcagggcctgttctgcagttggacagacagagccctctagctgctttctggaagactgaagggcag

SEQ ID NO: 6274 - DNA, 733 bp, Artificial Sequence
  Synthetic oligonucleotide
gtgatgttggagggagggagtgcaggcaggggctgtgagggagttcaggtcagaaacaggtggcgcctggattcaggctgtggtggtcacggtggggatgaggggctgctttggattgtgctggggatgtggggtggtgcgctgctgcatgactactgccaggtctctctgctcttagtgtctgcatccagggctgggagggggtcaaatgaatcacactatcggccccaggcccaccaagcctggggaggtggccacccttccatgatggcatttggatgttccctgtgtgtggggagggcacagggactccattcgtagaccacctctgggacagtgtgtctgcctctgaggtcagacgctctgcactgggacagggtggagtggagggaaatccagcttggggctcattggaggggcttgctggcagacaccgccctttgtgggaaactgactgtgggagaggggaaccccaacctctgtcaccacatccctcttccctgttgtcacacctgtcacctgctgccatagccatgagacttcccaagggtcactgctgccactcactgcacagcctggaagggagtccacaggggacatacagtgagcaagagacctgtgccactcaggcctcctgggggtgtccccagtgcagccatgatgataatcacagctaccattcaccaagccctgcccacagtctaacctactctattcacaacactcccagcag

SEQ ID NO: 6275 - DNA, 171 bp, Artificial Sequence
  Synthetic oligonucleotide
cagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggag

SEQ ID NO: 6276 - DNA, 131 bp, Artificial Sequence
  Synthetic oligonucleotide
ggatgcactgcgggacggtggctctgcggtggatgcagccattgcagccctgttgtgtgtggggctcatgaatgcccacagcatgggcatcgggggtggcctcttcctcaccatctacaacagcaccacac

SEQ ID NO: 6277 - DNA, 169 bp, Artificial Sequence
  Synthetic oligonucleotide
gggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgt

SEQ ID NO: 6278 - DNA, 158 bp, Artificial Sequence
  Synthetic oligonucleotide
tgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccg

SEQ ID NO: 6279 - DNA, 150 bp, Artificial Sequence
  Synthetic oligonucleotide
ggggcattgtgacagctgaggacctgaacaactaccgtgctgagctgatcgagcacccgctgaacatcagcctgggagacgtggtgctgtacatgcccagtgcgccgctcagcgggcccgtgctggccctcatcctcaacatcctcaaag

SEQ ID NO: 6280 - DNA, 137 bp, Artificial Sequence
  Synthetic oligonucleotide
ggtacaacttctcccgggagagcgtggagagccccgagcagaagggcctgacgtaccaccgcatcgtagaggctttccggtttgcctacgccaagaggaccctgcttggggaccccaagtttgtggatgtgactgag

SEQ ID NO: 6281 - DNA, 149 bp, Artificial Sequence
  Synthetic oligonucleotide
ctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctcta

SEQ ID NO: 6282 - DNA, 128 bp, Artificial Sequence
  Synthetic oligonucleotide
ctttggctccaaggtccgctccccggtcagcgggatcctgttcaataatgaaatggacgacttcagctctcccagcatcaccaacgagtttggggtacccccctcacctgccaatttcatccagccag

SEQ ID NO: 6283 - DNA, 144 bp, Artificial Sequence
  Synthetic oligonucleotide
gcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctac

SEQ ID NO: 6284 - DNA, 172 bp, Artificial Sequence
  Synthetic oligonucleotide
tgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccactctct

SEQ ID NO: 6285 - DNA, 70 bp, Artificial Sequence
  Synthetic oligonucleotide
cgggtgcagcccaaaactgtcttctgaggaagaggtgctctcctgggcccccactgtccccaggcctcag

SEQ ID NO: 6286 - DNA, 69 bp, Artificial Sequence
  Synthetic oligonucleotide
caaggcaagtgaggtgctgccgtcatccaggctggacagttcagtgatttgcctgaggccccacagcag

SEQ ID NO: 6287 - DNA, 87 bp, Artificial Sequence
  Synthetic oligonucleotide
agttcaactggagacagagaaaccagctagaggcagagggaggtaacacggagtcccccagaaaggtctgggctgcgcgtgcttcag

SEQ ID NO: 6288 - DNA, 21 bp, Artificial Sequence
  Synthetic oligonucleotide
gtaacctcccttgaccttcag

SEQ ID NO: 6289 - DNA, 56 bp, Artificial Sequence
  Synthetic oligonucleotide
gagaacgagaaggctgcctgatcagagagtccctgaagaagattctgtggctacag

SEQ ID NO: 6290 - DNA, 41 bp, Artificial Sequence
  Synthetic oligonucleotide
gcttcagcagagtgtgagggagaccccggttatttcctcag

SEQ ID NO: 6291 - DNA, 77 bp, Artificial Sequence
  Synthetic oligonucleotide
ctatttccaccaaatcctcctgtctttcgtggccaacaccccaggcaaggcttggggcccccgtctgctgctggacg

SEQ ID NO: 6292 - DNA, 87 bp, Artificial Sequence
  Synthetic oligonucleotide
gaaaagctgaggtcatcaacgcccgcgaggtggcccccaggctggcctttgccaccatgttcaacagctcggagcagtcccagaagg

SEQ ID NO: 6293 - DNA, 24 bp, Artificial Sequence
  Synthetic oligonucleotide
catcgagcagcagcctgtcttgtg

SEQ ID NO: 6294 - DNA, 39 bp, Artificial Sequence
  Synthetic oligonucleotide
gtggtccgcaacatgacctccgagttcttcgctgcccag

SEQ ID NO: 6295 - DNA, 27 bp, Artificial Sequence
  Synthetic oligonucleotide
ggaagcagccgctctcgtccatgtgcc

SEQ ID NO: 6296 - DNA, 86 bp, Artificial Sequence
  Synthetic oligonucleotide
cgacgatcatggtgggccaggacggccaggtccggatggtggtgggagctgctgggggcacacagatcaccacggccactgcactg

SEQ ID NO: 6297 - DNA, 80 bp, Artificial Sequence
  Synthetic oligonucleotide
gccatcatctacaacctctggttcggctatgacgtgaagcgggccgtggaggagccccggctgcacaaccagcttctgcc

SEQ ID NO: 6298 - DNA, 34 bp, Artificial Sequence
  Synthetic oligonucleotide
caacgtcacgacagtggagagaaacattgaccag

SEQ ID NO: 6299 - DNA, 174 bp, Artificial Sequence
  Synthetic oligonucleotide
cagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagg

SEQ ID NO: 6300 - DNA, 175 bp, Artificial Sequence
  Synthetic oligonucleotide
gtaggtacaaaagggcctccatttctcattcctgccccagggccatctggagtgacacctttccgggaatcagcaggtgtgtctggagctcacctgtgtgcccagccctaacttaggctgttggttgcctcctgtgaaggttctgcggagttcccacccttgacttgtattccag

SEQ ID NO: 6301 - DNA, 242 bp, Artificial Sequence
  Synthetic oligonucleotide
agaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagag

SEQ ID NO: 6302 - DNA, 209 bp, Artificial Sequence
  Synthetic oligonucleotide
agtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaag

SEQ ID NO: 6303 - DNA, 178 bp, Artificial Sequence
  Synthetic oligonucleotide
gtgggtgtggactggcctgggtgcacctggatggtgtgtgatttctggatctaaaagacagaaggactcagtctcatatccttccatctgggggaggaatggacttacgcagggccatttcctccaaaactaactgtggctagagtctaattctaatacatctcgagcctgaagctct

SEQ ID NO: 6304 - DNA, 218 bp, Artificial Sequence
  Synthetic oligonucleotide
ggcctgtgggagcagtgccagcttctgaagagcacctcggtgtttgctccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgca

SEQ ID NO: 6305 - DNA, 123 bp, Artificial Sequence
  Synthetic oligonucleotide
gcccagtgtgccctgctggtatggagtataggcagtgtgtgtccccttgcgccaggacctgccagagcctgcacatcaatgaaatgtgtcaggagcgatgcgtggatggctgcagctgccctg

SEQ ID NO: 6306 - DNA, 137 bp, Artificial Sequence
  Synthetic oligonucleotide
gggagtgccttgtcacaggtcaatcacacttcaagagctttgacaacagatacttcaccttcagtgggatctgccagtacctgctggcccgggattgccaggaccactccttctccattgtcattgagactgtccag

SEQ ID NO: 6307 - DNA, 139 bp, Artificial Sequence
  Synthetic oligonucleotide
tgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaag

SEQ ID NO: 6308 - DNA, 1321 bp, Artificial Sequence
  Synthetic oligonucleotide
cctcatttagcttaagttctaatggagagagacagacaataaacaaagcaaacaagtaaattatattatagatcggaaagtgatagatcctgggggaaataaagcagagaaaggggcaggatgtgccaggattggggggatttaaattttaaataaggaggtgggagaaggcctaatgtgacaacatttggtatttgtcaagcaaacaaggaaacattactctgtcccctttcttaacagtgtttacttgggttcgatttctatgggcctgggaccttctactggattgttaaccctgcattttgttaggttggagctggaagctgaaaaggggctctaagagctgaccctagcccctgagggattcagaacgcagggaggtcatcccaccttggtaatgacatgcggagagggagtcaggactcctgggtcccagcccccgctccaccttcaaatcggggtcctctccgtagaaaccagcagatgcccccagctgtgtgggggaagggcgggctccactctgctggttgttcccgaatgtgcactttgggctcagaactttgttcagttctgagaatggacagtaaaccacatgctcatggcctggagtttgaactgtgccgctgctttgctgctgtcaccctggcaggctgcctcagagcctctgcagactcctactcctatccatcatcaccctcagagtcttctgtggctcgtggccctttctcttcagtgatgcccagggcctgagtggcaggcagcaggttgtggggaggtgtttcttgtcattaaccgtgagctcccggagggcttggaccacacctggcagcctgctgggcccacaccgagtgaccaacgcgaagtctttctatatagaggggccttgagtttgcacgtaactctgggtgggggggtcaggcccactggtgtggatggcacagagggcagagtgcttcgggctgggctcaacctgcctactcaccctagctccgccactacctccctgaccttaggcaagtcactttgcctctttgggcctcccttctccatccttagatgatctgataatttctaaaatctcttgtggcagtacagggctctgatgatttgggaacagggatggagctggtaaatttacactgcagttcactttcccccgcccccccttttgcagcctagggcttagctgccttttattacattcatatttatgtttcacccggggaacttttttttttttattaaaaccatctcattagctaaacaactatgccgctgctttcgcggcagcggctccagagtggcctggtctctcctgcag

SEQ ID NO: 6309 - DNA, 196 bp, Artificial Sequence
  Synthetic oligonucleotide
ctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatga

SEQ ID NO: 6310 - DNA, 241 bp, Artificial Sequence
  Synthetic oligonucleotide
gtatgtgaacccgggggcaaggcagggacctcgcagaatctcgaggtctccacattagtgcagtgcgttccggaggcagtgctcccaccgcggagggcgggggcggggagcgaggaaaggggtcgggctttgtttttaccgtcagcacttgatcatctgaactgggccatttgctcttcaaagtccctttattgggcgcccgccacaggccaacccccgggaaagaaaaaaaaaaaaaaag

SEQ ID NO: 6311 - DNA, 216 bp, Artificial Sequence
  Synthetic oligonucleotide
ccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtg

SEQ ID NO: 6312 - DNA, 241 bp, Artificial Sequence
  Synthetic oligonucleotide
agctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtg

SEQ ID NO: 6313 - DNA, 161 bp, Artificial Sequence
  Synthetic oligonucleotide
gcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatg

SEQ ID NO: 6314 - DNA, 139 bp, Artificial Sequence
  Synthetic oligonucleotide
tgtctgtcgggaccggaagtggaactgcacagaccatgtgtgtgatgccacgtgctccacgatcggcatggcccactacctcaccttcgacgggctcaaatacctgttccccggggagtgccagtacgttctggtgcag

SEQ ID NO: 6315 - DNA, 135 bp, Artificial Sequence
  Synthetic oligonucleotide
gattactgcggcagtaaccctgggacctttcggatcctagtggggaataagggatgcagccacccctcagtgaaatgcaagaaacgggtcaccatcctggtggagggaggagagattgagctgtttgacggggag

SEQ ID NO: 6316 - DNA, 147 bp, Artificial Sequence
  Synthetic oligonucleotide
gtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccag

SEQ ID NO: 6317 - DNA, 141 bp, Artificial Sequence
  Synthetic oligonucleotide
gagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaa

SEQ ID NO: 6318 - DNA, 977 bp, Artificial Sequence
  Synthetic oligonucleotide
gtgaggaccttgagggtagtgggaagcagatggtcccaaggcttggcctggtggtatggacacagagtgtgaccttctaacgtggacactaccctcgtgtcttgacatgatctgcaccaagacaccacttcggctttttttcttggctttcaatctgggaaacaaaaagtaaaatcaacagtttctaggggaagcaatgcctggcaaaacatttccttctgcatgagaagtaactccccttggcatgtgccaatgcttctctttcagccccagtcttaggatttgttctcttattgaagtatcttgttttcaacaccagagccagagatttccttttcctgtcactgctgcatttgtccagaccaaaagaccttcctctcccaccccctaaaaccccttggtgcccatttcttgtctcacagaaattcttttctggccttaattttggtgattttgagtcctcgtattatgacttatttttgtgtcttcatctctaatgacaaggaggaattccgcaaggttaagtgcagttgtctctctcttttttttttttttttgagacagagtctcgctctgtcacccaggctggagtgcaatggcatgatcttggcttagtgcagcctctgcctcctgggctcaagcgattctcctgcctcaacctcccgagtacctgggattacaggcacctgccaccacgcccagctaatttttgtatttttagtagagacaaggtttcaccatgttggtcaggctggccttgaactcctgactcaggtgatctacccacctcggcctcccaaagtgctgggattacaggtgtgagccaccatgcccgaccatagtgcagttgtctcttatctgctgcatgtatgtgtgtacacacatgtggacatgggcttgtacatggacatatgtgactacagaagtctgtgtacacacacagccatgcacacatacatgctgctgtgtaacaccac

SEQ ID NO: 6319 - DNA, 815 bp, Artificial Sequence
  Synthetic oligonucleotide
caatgtgggagagactggttgaaaacatggatctcaattctctttctatctatgcagtgattttcggtctctgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctctttgctgaattgaggcaaagaaagacagtgaccagcacatatgtgtgtttgtgtttttgtaaaagcacccacatgctcatgaggctaagagtgggttgtgaggacagatgggtggctgagcagggaggtaggcagagggacagagggaatgttcttctggaaaatcctcaggctcattgtgttctgcagaaggccagcagcactgcattattcaactcttcttgctggaatgcagattagaaactaagaatcttgccttcccactcattccctctttgagaccattgagctacatttctccttctacctggacccccttatccttaaattgaccatcagaacatttgcacccagactaagagccagagttcctgacacctggccataggcctgggccacctgaggctgcctttgcag

SEQ ID NO: 6320 - DNA, 157 bp, Artificial Sequence
  Synthetic oligonucleotide
gtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcc

SEQ ID NO: 6321 - DNA, 426 bp, Artificial Sequence
  Synthetic oligonucleotide
gtgagtactgacgccctcatgttctcagatgccctcccttcttcccatgtgtctatgcttgaagaccttgtgagtgcagggggatatcttcatgggcgagagaagacagagtgttagtagggactggatggccaagggctaaggagggttaagacattggctgtgtaagaagtttatattacgggtgaggtgggacatggattcaaggcatgaacatgtggagacttttcttctggagagattctggcaggggagaagagggaatactgatgaaaagaaggaagtcgatttatgtctttaattaggcgtgattatatttgccaatatgagtgatcaactcatacattcatgtctatagaatcttgcttctttggacagaagcaacttaatgtttttatgtagaaaactgggccgggcacagtgact

SEQ ID NO: 6322 - DNA, 159 bp, Artificial Sequence
  Synthetic oligonucleotide
cccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccag

SEQ ID NO: 6323 - DNA, 136 bp, Artificial Sequence
  Synthetic oligonucleotide
ggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttg

SEQ ID NO: 6324 - DNA, 445 bp, Artificial Sequence
  Synthetic oligonucleotide
gtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctggg

SEQ ID NO: 6325 - DNA, 1379 bp, Artificial Sequence
  Synthetic oligonucleotide
ccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcccagtccaaaggggacatcctgcagcggttgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctg

SEQ ID NO: 6326 - DNA, 141 bp, Artificial Sequence
  Synthetic oligonucleotide
ggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcg

SEQ ID NO: 6327 - DNA, 165 bp, Artificial Sequence
  Synthetic oligonucleotide
gagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctg

SEQ ID NO: 6328 - DNA, 171 bp, Artificial Sequence
  Synthetic oligonucleotide
aatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggag

SEQ ID NO: 6329 - DNA, 138 bp, Artificial Sequence
  Synthetic oligonucleotide
gtgacggtgaatgggagactggtctctgttccttacgtgggtgggaacatggaagtcaacgtttatggtgccatcatgcatgaggtcagattcaatcaccttggtcacatcttcacattcactccacaaaacaatgag

SEQ ID NO: 6330 - DNA, 342 bp, Artificial Sequence
  Synthetic oligonucleotide
ggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtg

SEQ ID NO: 6331 - DNA, 200 bp, Artificial Sequence
  Synthetic oligonucleotide
ctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccag

SEQ ID NO: 6332 - DNA, 206 bp, Artificial Sequence
  Synthetic oligonucleotide
cctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaag

SEQ ID NO: 6333 - DNA, 150 bp, Artificial Sequence
  Synthetic oligonucleotide
gtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcg

SEQ ID NO: 6334 - DNA, 140 bp, Artificial Sequence
  Synthetic oligonucleotide
caatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtg

SEQ ID NO: 6335 - DNA, 791 bp, Artificial Sequence
  Synthetic oligonucleotide
ttattttgttgctcttcttgacaagagtgtacttggtgtagggcctcacaatttggagttgattgatcttttttttttctttcttgagatggagtcttgctctgttgccaggctggagtgcaatgtcacgatctcggctcactgcaacctccgcctcctgggttcaagcgatttccctgtctcagcctcccgagtagctgggactgcaggcacgtgccaccacacccagctaatttttgtagttttagtagagatgggatttcatcatgttggccaggatggtctcgatctcttgacctcgtgatccgcccacctcggcctcccaaagtgctgggattacaggtgtgagccaccgtgcctggcctggaggtggttgatctttaagattttctctacccttgggcgtctgtaagactggacaggccatcagcgtgaaacaaactctggtctatgaagtccggactagctggtggggctgggaggtagttcccttcgttcatctctagttcagttatcagctagccagtttactgttgctatatctcaatccttcaagcatttaactggtcggaagagtctacatagcagccctgttcataggatacaagctgtaaaactgggactccacttctggtctgtgttctgggtgtgggggctttattatacactgtcttcttgtttcatggttctgcagattgtttcgtcatctccatggagtcaagctcatggtttgaagtggctttgtgaaccaaacactgtctctgactttacccactcctctttccttccag

SEQ ID NO: 6336 - DNA, 129 bp, Artificial Sequence
  Synthetic oligonucleotide
cgtgatgagacgctccaggatggctgtgatactcacttctgcaaggtcaatgagagaggagagtacttctgggagaagagggtcacaggctgcccaccctttgatgaacacaagtgtctggctgaggga

SEQ ID NO: 6337 - DNA, 507 bp, Artificial Sequence
  Synthetic oligonucleotide
gtgagtactcattctgctttcctctttactgtctcaatctctaagaacaagattcttctgaatagtgtgcatcccagctccggcataatttctcagtgtctgaggcacatctctggcctagttgaagaatcagtgagattacgaaatcaaagcctacggagagataaaattctctgcaatataggatgttttaaaaaaatattttccttaagggaggctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgcaattttgctgttttcttag

SEQ ID NO: 6338 - DNA, 1960 bp, Artificial Sequence
  Synthetic oligonucleotide
gtgagtgcgttactaatatcttgtcccttgaaacccatcagagcaagtccaggggctctttgcagcttgctccttgaaacccattagcaagccgcatgactgttctttggagtaagctttatttcagaaagatatttcgtgaccactggtcagtcattatgttcagtcttgcagggagcagcctcccctccttggatgtcatcagactgccctcttgaactcccttttagatcccatggagcaatctctttccccttttcctgcaaactccctcctgtctccagcttcttatgtgccttttccctcataggatctttgattgctcatagtcctatcctgggacgatatgttccctctctaaccaaagcttcttgaagacaggcaccttggatctatgatcctgacagagtagactctcaacacatatctattcatgagtgtgctaaagctatctcaaagagaaagcgaagccaccagctggctgacaacagcccacatgtgctgtgggggctggtctaagtttatcaccccctcttcttcactctgagctcctctttacctcgtagttatgtcctactgattggttctcattgctcacagcagcagctttggagacgagacacaaatctgcacatcagacagtgttcttcccatacatgcttgtgtttgtgagcacaaataactttcaggatcccaatgctaatgccataatttctgaatatagaattacttgcctggactaagattttttgttttagattagggtatttcttttctgccctgggttcacaggtccatgcttgtttacagatagagaaaggaagagtgaaaacatgaatactttcagtgttcaatcattcattcttgacagcccctgcaattgctgtaaccaaatctcagatcgaggaagcactctgaaagcatgtctttctatgattcccatttgaatggtttaagaatgtgaagtcaggaaaccatcagagaagaagaattctctctaggcacactgcacgtggaatttgattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatctaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtacccgaagagaggccttcacaaaggtgcctagggatcttctcggtccccagagaggcagggtatgcccttacatcaccatgacttcgcctttcctcttaccccaaggcaggaatgaagagatagtaattatacttattgactacttcattgcccattagcttctgaatgtagttacaagcacaagagggttgctttagccatgtggtttttagagtctacaatgatacaaaggcaagtcttcctcattttacatcaccatagcacagtgaatttaggctcttcctgcaattaaaattgtaccattaagtgagttaagtccagcaataactatatctctgcatatttcgggccaggaacagctgaggtgaaccaggataactgaattccctccctgtggctggctttatttggttactgtgaaagggacctatttccagcccagtgagggcactggggctgaagagtgttctctagaaccccagccagtcctcaagtttcatctctcacctgtcctgtag

SEQ ID NO: 6339 - DNA, 582 bp, Artificial Sequence
  Synthetic oligonucleotide
gtaagggctctgcttcaataagggctgggtgtggagggctgagcctccgtgttcggatacctatccttagttacattctagaaggatctggaaaattcgcagggaagagaagggaaataaactggaagcatttttttttaagcaaatgttttattgaagtaactggaaatttttgactccaggaaaaaaacaaaaatggaggaaagactcagcaaatcctttacagaaaatggagagttatttatgcaagatgggggccacaattcttgaagatcagtcaaacatatataaaattttcctgcataaaacatgcataatcaggcataaaacattttatgcattaacatgcataaaaattgcagctagaggggtgtgggtatgatattattaccatagagaagaggacatgtcagacctatgatcttcctttacaaattgcctagctgtcctgggtgcttctgggtgagatcagacctgccttgcttggagggggtcagggagaaagcaggctgccccagagccctgcctaagccaggacttcccaccattgtgaagctcccatcttcctctgctttcttgcag

SEQ ID NO: 6340 - DNA, 161 bp, Artificial Sequence
  Synthetic oligonucleotide
ggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaa

SEQ ID NO: 6341 - DNA, 162 bp, Artificial Sequence
  Synthetic oligonucleotide
atgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgc

SEQ ID NO: 6342 - DNA, 77 bp, Artificial Sequence
  Synthetic oligonucleotide
gtgggcggcaccattgtccagcagctgagtttcccagggaccttggagatagccgcagccctcatttgcaggggaag

SEQ ID NO: 6343 - DNA, 55 bp, Artificial Sequence
  Synthetic oligonucleotide
atgattcctgccagatttgccggggtgctgcttgctctggccctcattttgccag

SEQ ID NO: 6344 - DNA, 100 bp, Artificial Sequence
  Synthetic oligonucleotide
ggaccctttgtgcagaaggaactcgcggcaggtcatccacggcccgatgcagccttttcggaagtgacttcgtcaacacctttgatgggagcatgtacag

SEQ ID NO: 6345 - DNA, 65 bp, Artificial Sequence
  Synthetic oligonucleotide
ctttgcgggatactgcagttacctcctggcagggggctgccagaaacgctccttctcgattattg

SEQ ID NO: 6346 - DNA, 78 bp, Artificial Sequence
  Synthetic oligonucleotide
gggacttccagaatggcaagagagtgagcctctccgtgtatcttggggaattttttgacatccatttgtttgtcaatg

SEQ ID NO: 6347 - DNA, 25 bp, Artificial Sequence
  Synthetic oligonucleotide
gtaccgtgacacagggggaccaaag

SEQ ID NO: 6348 - DNA, 116 bp, Artificial Sequence
  Synthetic oligonucleotide
ggaccttgacctcggacccttatgactttgccaactcatgggctctgagcagtggagaacagtggtgtgaacgggcatctcctcccagcagctcatgcaacatctcctctggggaa

SEQ ID NO: 6349 - DNA, 9 bp, Artificial Sequence
  Synthetic oligonucleotide
atgcagaag

SEQ ID NO: 6350 - DNA, 112 bp, Artificial Sequence
  Synthetic oligonucleotide
agggacagctcctggatgaaggcctctgcgtggagagcaccgagtgtccctgcgtgcattccggaaagcgctaccctcccggcacctccctctctcgagactgcaacacctg

SEQ ID NO: 6351 - DNA, 47 bp, Artificial Sequence
  Synthetic oligonucleotide
catttgccgaaacagccagtggatctgcagcaatgaagaatgtccag

SEQ ID NO: 6352 - DNA, 101 bp, Artificial Sequence
  Synthetic oligonucleotide
gtgacctccgcatccagcatacagtgacggcctccgtgcgcctcagctacggggaggacctgcagatggactgggatggccgcgggaggctgctggtgaag

SEQ ID NO: 6353 - DNA, 95 bp, Artificial Sequence
  Synthetic oligonucleotide
ctactgtgaggagggcttcatgcactgtaccatgagtggagtccccggaagcttgctgcctgacgctgtcctcagcagtcccctgtctcatcgca

SEQ ID NO: 6354 - DNA, 104 bp, Artificial Sequence
  Synthetic oligonucleotide
gtccggcatgagaacagatgtgtggccctggaaaggtgtccctgcttccatcagggcaaggagtatgcccctggagaaacagtgaagattggctgcaacacttg

SEQ ID NO: 6355 - DNA, 114 bp, Artificial Sequence
  Synthetic oligonucleotide
gtgcctctggactcatcccctgccacctgccataacaacatcatgaagcagacgatggtggattcctcctgtagaatccttaccagtgacgtcttccaggactgcaacaagctg

SEQ ID NO: 6356 - DNA, 117 bp, Artificial Sequence
  Synthetic oligonucleotide
actgcagccagcccctggacgtgatccttctcctggatggctcctccagtttcccagcttcttattttgatgaaatgaagagtttcgccaaggctttcatttcaaaagccaatatag

SEQ ID NO: 6357 - DNA, 86 bp, Artificial Sequence
  Synthetic oligonucleotide
gggatgccttgggctttgctgtgcgatacttgacttcagaaatgcatggtgccaggccgggagcctcaaaggcggtggtcatcctg

SEQ ID NO: 6358 - DNA, 58 bp, Artificial Sequence
  Synthetic oligonucleotide
gtcacggacgtctctgtggattcagtggatgcagcagctgatgccgccaggtccaaca

SEQ ID NO: 6359 - DNA, 42 bp, Artificial Sequence
  Synthetic oligonucleotide
gtaagaatctggtgtacagtcctcaattcaggagagcgagac

SEQ ID NO: 6360 - DNA, 44 bp, Artificial Sequence
  Synthetic oligonucleotide
gatttgttaggatttgcatggatgaggatgggaatgagaagagg

SEQ ID NO: 6361 - DNA, 14 bp, Artificial Sequence
  Synthetic oligonucleotide
cccggggacgtctg

SEQ ID NO: 6362 - DNA, 51 bp, Artificial Sequence
  Synthetic oligonucleotide
gaccttgccagaccagtgccacaccgtgacttgccagccagatggccagac

SEQ ID NO: 6363 - DNA, 113 bp, Artificial Sequence
  Synthetic oligonucleotide
cttgctgaagagtcatcgggtcaactgtgaccgggggctgaggccttcgtgccctaacagccagtcccctgttaaagtggaagagacctgtggctgccgctggacctgcccct

SEQ ID NO: 6364 - DNA, 50 bp, Artificial Sequence
  Synthetic oligonucleotide
gtgtgtgcacaggcagctccactcggcacatcgtgacctttgatgggcag

SEQ ID NO: 6365 - DNA, 55 bp, Artificial Sequence
  Synthetic oligonucleotide
ttccaactgcagctcagccccaagacttttgcttcaaagacgtatggtctgtgtg

SEQ ID NO: 6366 - DNA, 103 bp, Artificial Sequence
  Synthetic oligonucleotide
ttcctggaagcctgggtcccggaccaccagccctgtcagatctgcacatgcctcagcgggcggaaggtcaactgcacaacgcagccctgccccacggccaaag

SEQ ID NO: 6367 - DNA, 75 bp, Artificial Sequence
  Synthetic oligonucleotide
ctcccacgtgtggcctgtgtgaagtagcccgcctccgccagaatgcagaccagtgctgccccgagtatgagtgtg

SEQ ID NO: 6368 - DNA, 105 bp, Artificial Sequence
  Synthetic oligonucleotide
tgtgtgacccagtgagctgtgacctgcccccagtgcctcactgtgaacgtggcctccagcccacactgaccaaccctggcgagtgcagacccaacttcacctgcg

SEQ ID NO: 6369 - DNA, 111 bp, Artificial Sequence
  Synthetic oligonucleotide
ggcttcacttacgttctgcatgaaggcgagtgctgtggaaggtgcctgccatctgcctgtgaggtggtgactggctcaccgcggggggactcccagtcttcctggaagagt

SEQ ID NO: 6370 - DNA, 41 bp, Artificial Sequence
  Synthetic oligonucleotide
gtcggctcccagtgggcctccccggagaacccctgcctcat

SEQ ID NO: 6371 - DNA, 5 bp, Artificial Sequence
  Synthetic oligonucleotide
gtaag

SEQ ID NO: 6372 - DNA, 41 bp, Artificial Sequence
  Synthetic oligonucleotide
agcgcatggaggcctgcatgctcaatggcactgtcattggg

SEQ ID NO: 6373 - DNA, 117 bp, Artificial Sequence
  Synthetic oligonucleotide
cccgggaagactgtgatgatcgatgtgtgcacgacctgccgctgcatggtgcaggtgggggtcatctctggattcaagctggagtgcaggaagaccacctgcaacccctgccccctg

SEQ ID NO: 6374 - DNA, 99 bp, Artificial Sequence
  Synthetic oligonucleotide
ggttacaaggaagaaaataacacaggtgaatgttgtgggagatgtttgcctacggcttgcaccattcagctaagaggaggacagatcatgacactgaag

SEQ ID NO: 6375 - DNA, 40 bp, Artificial Sequence
  Synthetic oligonucleotide
ggtaaaattatgaaaattccaggcacctgctgtgacacat

SEQ ID NO: 6376 - DNA, 14 bp, Artificial Sequence
  Synthetic oligonucleotide
gtgaggagcctgag

SEQ ID NO: 6377 - DNA, 20 bp, Artificial Sequence
  Synthetic oligonucleotide
tgcaacgacatcactgccag

SEQ ID NO: 6378 - DNA, 6 bp, Artificial Sequence
  Synthetic oligonucleotide
gctgca

SEQ ID NO: 6379 - DNA, 10 bp, Artificial Sequence
  Synthetic oligonucleotide
gtatgtcaag

SEQ ID NO: 6380 - DNA, 48 bp, Artificial Sequence
  Synthetic oligonucleotide
gtgggaagctgtaagtctgaagtagaggtggatatccactactgccag

SEQ ID NO: 6381 - DNA, 226 bp, Artificial Sequence
  Synthetic oligonucleotide
ggcggaagcgagggcggggacagcggaatgacgttttaaggacgcttgcgcgcgggatttaaactgcggcggtttacgcggcgttaagacttcgtagggttagcgaaattgaggtttcttggtattgcgcgtttctcttccttgctgactctccgaatggccatggactcgtcgcttcaggcccgcctgtttcccggtctcgctatcaagatccaacgcagtaatg

SEQ ID NO: 6382 - DNA, 358 bp, Artificial Sequence
  Synthetic oligonucleotide
ggcaggaagccgtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagccatcaagaggtgcttggggggctgtgcccagcaggacctcactgcccagcagatcagcaggggagccaagtggcctagatctgctgtggagtacccgactgtttgcctgcctgtctgccctcctcttcacctcattctcatcactgacgtctaccattggcttggaaatcagaaacccatatccatctagatg

SEQ ID NO: 6383 - DNA, 133 bp, Artificial Sequence
  Synthetic oligonucleotide
gaatatgggaagttggcgagcccctttcctggtagctgggacctatttcaccttgtacagaaacttggaggtttgcccctgaccaccctcgagatcgtgcagcactgactggctactgctctcggttctccag

SEQ ID NO: 6384 - DNA, 123 bp, Artificial Sequence
  Synthetic oligonucleotide
gtcttcgaagccgctccactcgcatgtccactgtctcagagcttcgcatcacggctcaggagaatgacatggaggtggagctgcctgcagctgcaaactcccgcaagcagttttcagttcctc

SEQ ID NO: 6385 - DNA, 123 bp, Artificial Sequence
  Synthetic oligonucleotide
ctgcccccactaggccttcctgccctgcagtggctgaaataccattgaggatggtcagcgaggagatggaagagcaagtccattccatccgaggcagctcttctgcaaaccctgtgaactcag

SEQ ID NO: 6386 - DNA, 332 bp, Artificial Sequence
  Synthetic oligonucleotide
actgcaacctccacttccctgggcttgagtgatcctccccacctcatcctcccaggtagctgggaccatagatgcattccaccgcaccctactgattttttgtatttttggtagagacagggtttcaccatgttgcccaggccaatctggaacttctgggttcaaggaatccgcctaccttgacttcccaaagtgctgggattacaggtgtaagctactgtgcctggctgaggttattttattttacttttttttgagacagagtctcgctctgtcgcccaggctggagtgcaatggcatggtcttggctcactgcagcctccacctcccag

SEQ ID NO: 6387 - DNA, 568 bp, Artificial Sequence
  Synthetic oligonucleotide
gtttaagtgattctcctgcctcagcctccccagtagctgggattacaggcatgtgccaccacgcctaggtaatttttgtatttttagtagagatggggttttaccatgttggtcaggctggtgtcgaactcctgacctcgtgatctgcccacctcagcctcccaaagtgctgggattacaggcgtgagccaccatgcccagccgaggttattttttaatatcctttggtgggctgaagctagtgaggcccacatggggaggggtctgatctttataaactgggttccacccccataccataggttggctagattcctgcattagtaaaaatcatgaaagtagtgctgaaactcttgtaggcagcagagtgagaaaaatgggaacaaaatccagtgctcccttcttgtgctctggagtatctaatggaggatgcaggggtcctagtgttagatcttggcctctgactgggccagacatgggattggaaggggtgggagttctggacaagctcgcttttgaaattgctctgaccctttgctgttggttgcctcctctcatccgcttgcag

SEQ ID NO: 6388 - DNA, 163 bp, Artificial Sequence
  Synthetic oligonucleotide
aattggccaagaaagaaattgatgtgatttccattcctagcaagtgtctcctcttggtacatgaacccaagttgaaagtggacttaacaaagtatctggagaaccaagcattctgctttgactttgcatttgatgaaacagcttcgaatgaagttgtctacag

SEQ ID NO: 6389 - DNA, 143 bp, Artificial Sequence
  Synthetic oligonucleotide
ctgtttgacctgctcaacaagaaggccaagctgcgcgtgctggaggacggcaagcaacaggtgcaagtggtggggctgcaggagcatctggttaactctgctgatgatgtcatcaagatgatcgacatgggcagcgcctgcag

SEQ ID NO: 6390 - DNA, 205 bp, Artificial Sequence
  Synthetic oligonucleotide
aacctctgggcagacatttgccaactccaattcctcccgctcccacgcgtgcttccaaattattcttcgagctaaagggagaatgcatggcaagttctctttggtagatctggcagggaatgagcgaggcgcggacacttccagtgctgaccggcagacccgcatggagggcgcagaaatcaacaagagtctcttagccctgaag

SEQ ID NO: 6391 - DNA, 521 bp, Artificial Sequence
  Synthetic oligonucleotide
gtgagtagggtcactttgaaggtgatggtacaggaggagacagagttgctttccacagagacacttagtcctgtccctgggctggaagctcagcactgctggctgcctgggtttccaggctgtaccgtgactgggcttccagaccctgctttaatgcacgagactccttgtggcctaaccaagcgtggaggaaaggatctattccctttaagatgtgtaggtgcagctcttggtttgggagaggtcattcctgcattacctgatgaaaagggggttccagaattcggaagatgggcctttgggtcagcaggagagggaagtccttgtcttttccatggcctccctcaggttcactggctcccagcctagaaaatagaaatagcctggatcataaggctgtgtccttgaatgacgtcctctttcctgttttatccccaagcccctgtatgtgagatctgccatccttcccctcaagagaatattctcccctaccctttgggtaggagtcctttcatgaggaa

SEQ ID NO: 6392 - DNA, 126 bp, Artificial Sequence
  Synthetic oligonucleotide
gtactagtacctacagctaggtgggatgcggaacaggactgggcaagggaagggcagtgatgagaggggaggaggctctggggcctcagggcctactgtatactcctctgtgactctgaacctgag

SEQ ID NO: 6393 - DNA, 124 bp, Artificial Sequence
  Synthetic oligonucleotide
caaggaccagactggcttgagctctctgagatgaccgagcagccagactatgacctggagacctttgtgaacaaagcggaatctgctctggcccagcaagccaagcatttctcagccctgcgag

SEQ ID NO: 6394 - DNA, 229 bp, Artificial Sequence
  Synthetic oligonucleotide
atgtcatcaaggccttgcgcctggccatgcagctggaagagcaggctagcagacaaataagcagcaagaaacggccccagtgacgactgcaaataaaaatctgtttggtttgacacccagcctcttccctggccctccccagagaactttgggtacctggtgggtctaggcagggtctgagctgggacaggttctggtaaatgccaagtatgggggcatctgggcccag

SEQ ID NO: 6395 - DNA, 168 bp, Artificial Sequence
  Synthetic oligonucleotide
ggcagctggggagggggtcagagtgacatgggacactccttttctgttcctcagttgtcgccctcacgagaggaaggagctcttagttacccttttgtgttgcccttctttccatcaaggggaatgttctcagcatagagctttctccgcagcatcctgcctgcgtgg

SEQ ID NO: 6396 - DNA, 126 bp, Artificial Sequence
  Synthetic oligonucleotide
actggctgctaatggagagctccctggggttgtcctggctctggggagagagacggagcctttagtacagctatctgctggctctaaaccttctacgcctttgggccgagcactgaatgtcttgta

SEQ ID NO: 6397 - DNA, 128 bp, Artificial Sequence
  Synthetic oligonucleotide
acctctttctactttactgtctccctagagatcctagaggatccctactgttttctgttttatgtgtttatacattgtatgtaacaataaagagaaaaaataaatcagctgtttaagtgtgtggaaag

SEQ ID NO: 6398 - DNA, 95 bp, Artificial Sequence
  Synthetic oligonucleotide
gtttaattcacagtgccaatgtaaggactgtgaacttggagaaatcctgtgtttcagtggaatgggcagaaggaggtgccacaaagggcaaagag

SEQ ID NO: 6399 - DNA, 66 bp, Artificial Sequence
  Synthetic oligonucleotide
attgattttgatgatgtggctgcaataaacccagaactcttacagcttcttcccttacatccgaag

SEQ ID NO: 6400 - DNA, 36 bp, Artificial Sequence
  Synthetic oligonucleotide
gacaatctgcccttgcaggaaaatgtaacaatccag

SEQ ID NO: 6401 - DNA, 49 bp, Artificial Sequence
  Synthetic oligonucleotide
aaacaaaaacggagatccgtcaactccaaaattcctgctccaaaagaaa

SEQ ID NO: 6402 - DNA, 26 bp, Artificial Sequence
  Synthetic oligonucleotide
ttcggaggaaatcatgtcttgtgaag

SEQ ID NO: 6403 - DNA, 75 bp, Artificial Sequence
  Synthetic oligonucleotide
gaagtggaaaaaatgaagaacaagcgagaagagaagaaggcccagaactctgaaatgagaatgaagagagctcag

SEQ ID NO: 6404 - DNA, 96 bp, Artificial Sequence
  Synthetic oligonucleotide
gagtatgacagtagttttccaaactgggaatttgcccgaatgattaaagaatttcgggctactttggaatgtcatccacttactatgactgatcct

SEQ ID NO: 6405 - DNA, 55 bp, Artificial Sequence
  Synthetic oligonucleotide
atcgaagagcacagaatatgtgtctgtgttaggaaacgcccactgaataagcaag

SEQ ID NO: 6406 - DNA, 91 bp, Artificial Sequence
  Synthetic oligonucleotide
gttcacagcaaggccactggtacagacaatctttgaaggtggaaaagcaacttgttttgcatatggccagacaggaagtggcaagacacat

SEQ ID NO: 6407 - DNA, 64 bp, Artificial Sequence
  Synthetic oligonucleotide
actatgggcggagacctctctgggaaagcccagaatgcatccaaagggatctatgccatggcct

SEQ ID NO: 6408 - DNA, 92 bp, Artificial Sequence
  Synthetic oligonucleotide
cccgggacgtcttcctcctgaagaatcaaccctgctaccggaagttgggcctggaagtctatgtgacattcttcgagatctacaatgggaag

SEQ ID NO: 6409 - DNA, 107 bp, Artificial Sequence
  Synthetic oligonucleotide
gtagtggggcagctagagctggttggccgggagagctactgggaagggatggggagggatcagtgcaaggaaagaagggacctcagttgttcctgctgcccccacag

SEQ ID NO: 6410 - DNA, 111 bp, Artificial Sequence
  Synthetic oligonucleotide
gagtgcatcagggccctgggacagaacaaggctcacaccccgttccgtgagagcaagctgacacaggtgctgagggactccttcattggggagaactctaggacttgcatg

SEQ ID NO: 6411 - DNA, 68 bp, Artificial Sequence
  Synthetic oligonucleotide
attgccacgatctcaccaggcataagctcctgtgaatatactttaaacaccctgagatatgcagacag

SEQ ID NO: 6412 - DNA, 89 bp, Artificial Sequence
  Synthetic oligonucleotide
gtcccaatcctctccgggccctgctggagagtcagctgggtgaggggcttttccagtccagctttagttttctctctccttggctgaag

SEQ ID NO: 6413 - DNA, 67 bp, Artificial Sequence
  Synthetic oligonucleotide
gcaaggttgccattccatccccttggagcctcaagcctcgaagcctgggcggtgccacattcctctg

SEQ ID NO: 6414 - DNA, 50 bp, Artificial Sequence
  Synthetic oligonucleotide
gtgagtaccaagggggtgctgtgggatctgagacctccttgtttcctcag

SEQ ID NO: 6415 - DNA, 101 bp, Artificial Sequence
  Synthetic oligonucleotide
ggtcaaggagctgagcccccacagtgggcccagtggagagcagttgattcaaatggaaacagaagagatggaagcctgctctaacggggcgctgattccag

SEQ ID NO: 6416 - DNA, 5 bp, Artificial Sequence
  Synthetic oligonucleotide
gcaat

SEQ ID NO: 6417 - DNA, 114 bp, Artificial Sequence
  Synthetic oligonucleotide
ttatccaaggaagaggaggaactgtcttcccagatgtccagctttaacgaagccatgactcagatcagggagctggaggagaaggctatggaagagctcaaggagatcatacag

SEQ ID NO: 6418 - DNA, 21 bp, Artificial Sequence
  Synthetic oligonucleotide
ctttaaaaaaatgtttctgag

SEQ ID NO: 6419 - DNA, 196 bp, Artificial Sequence
  Synthetic oligonucleotide
ggtactgtttgcccccatgcgcatggtgaccgtccccccacgtcactactgcacagtggccaaccctgtgtctcgggatgcccagggcttggtgctgtttgatgtcacagggcaagttcggcttcgccacgctgacctcgagatccggctggcccaggaccccttccccctgtacccaggggaggtgctggaaaag

SEQ ID NO: 6420 - DNA, 124 bp, Artificial Sequence
  Synthetic oligonucleotide
gacatcacacccctgcaggtggttctgcccaacactgccctccatctaaaggcgctgcttgattttgaggataaagatggagacaaggtggtggcaggagatgagtggcttttcgagggacctg

SEQ ID NO: 6421 - DNA, 132 bp, Artificial Sequence
  Synthetic oligonucleotide
gcacgtacatcccccggaaggaagtggaggtcgtggagatcattcaggccaccatcatcaggcagaaccaggctctgcggctcagggcccgcaaggagtgctgggaccgggacggcaaggagagggtgacag

SEQ ID NO: 6422 - DNA, 1136 bp, Artificial Sequence
  Synthetic oligonucleotide
gtaatggctgggagtgagcagcagtgctgccacgtggccttggccttggtggcggcttcctctgggtgtgtggaagaggtgggcagggacttcagcagcatggagagccatatcaggtgggctgtctggttgggggagggcactacgtggagtgtttgccatccttctgccttaaatgtctcatttgaaatgttagaaccaaccaggtgcggtagctcacatctgtaatctcagcactttgggaggccgaggcgggcggatcacctgaggtcaggagttcaagactagcctggccaacatgggaaaccctgtctctactaaaagtacaaacattagtcaggcgtggtggtggtctgagtagtcccagatacttgggaggctgagacaggagaattgcttgaactgggaagcggaggttgcagtgagccgagatcacaccactgcacttcagccagggtgacagagtgagactctgtcaaaaaaaaatattagcatgtccactgagaggacaagtgggggtttaggacagggaccctttcccacagcagacctggtttccagcataaaggtctgatggggtggccagggaacaggaaggacctcctccctcatgcccatatcccggtggaatctttcatttttttctgcttcacctaaaaccttgaccttgatttgacctcgggccacatctccaaccttctctaagaatccaagctggaagtccagcttggaatccgagggagcatccgtgtacacagcctacttcaccatccccgaggtgccctccaaactgccccatgaaggaagattctagaaataacattgagcaccttctctatgccaagagctgtttgagctagacatgtgaagatgtcattcacccctagaccctgcaaggtagccaccgtcaagtccacttgacacatgaggaaactgaagcccaaggggtgaggtagttagcccacgatgacagggccagcagatggcaaacccggggtggagcctggcctccccgtagagaaggtgtttaacctcgtggcgcgccttccctggatgggctctgctttgggacagctgggcggatcttcctcccttccacccttacgggcagcttccctccctgtcctcgtcccaag

SEQ ID NO: 6423 - DNA, 137 bp, Artificial Sequence
  Synthetic oligonucleotide
ctggcagacaggggtgagaaggacacagctaagagcctccagcccttggcgccccggaacaagacccgtgtggtcagctaccgcgtgccccacaacgctgcggtgcaggtgtacgactaccgagagaagcgagcccg

SEQ ID NO: 6424 - DNA, 541 bp, Artificial Sequence
  Synthetic oligonucleotide
cccttccatgctcctcgtccctggaacatgttccagctgacatgttccagccccactggcttcctctgctccttcaatgcacagcttggacccacctgaaggccttttgcaatggctattcctgctgcccagaaagcttccccccgcccctgagctcccttccaggcaggcttctccttctggcttcagcccaaagatcccctccttggggaacacttttctttctctcacagctgaatagcaccctctttgcctggtctctcccacacttgtcactgtctgaaatcctccttgtatacttgttcttttcccactcaagtggcgtgaaagtagggggccgcagtcacgcctgcatttgtccggcctagaatgacactggcttgtggcgcgtataccattctgggttgagttgcgtattgggtgccttctaggggctggggtctgtcctgggcaccggtttggttggtggccgctgcccttggcgctcctgttcctgctctggccccatgccagcctctcacctgcgctccgtctcctccag

SEQ ID NO: 6425 - DNA, 154 bp, Artificial Sequence
  Synthetic oligonucleotide
ggtggccagtgggcccagccctggggaggggatatccccccagtctgctcaggcccctcaagctcctggagacaaccacgtggtgcctgtactgcgctaactcctgattaatacaatggaagtttctgggcatttacaatttcaaaacttatct

SEQ ID NO: 6426 - DNA, 104 bp, Artificial Sequence
  Synthetic oligonucleotide
cacccctgggcttggcctgccttgccctgccgggaagtgatccccaaggcagggtgagagttccccatctgaggcgtttgttgcagctacctgcacttctagat

SEQ ID NO: 6427 - DNA, 66 bp, Artificial Sequence
  Synthetic oligonucleotide
tcatcttcttgtgagccctgggcttaggagtcaccatggcaactgaagagttcatcatccgcatcc

SEQ ID NO: 6428 - DNA, 94 bp, Artificial Sequence
  Synthetic oligonucleotide
ccccataccactatatccatgtgctggaccagaacagcaacgtgtcccgtgtggaggtcgggccaaagacctacatccggcaggacaatgagag

SEQ ID NO: 6429 - DNA, 95 bp, Artificial Sequence
  Synthetic oligonucleotide
gggaagaatggctggtcaccacagtaggggcgtacctcccagcggtgtttgaggaggttctggatttggtggacgccgtcatccttacggaaaag

SEQ ID NO: 6430 - DNA, 71 bp, Artificial Sequence
  Synthetic oligonucleotide
acagccctgcacctccgggctcggcggaacttccgggacttcaggggagtgtcccgccgcactggggagga

SEQ ID NO: 6431 - DNA, 103 bp, Artificial Sequence
  Synthetic oligonucleotide
gtggctggtaacagtgcaggacacagaggcccacgtgccagatgtccacgaggaggtgctgggggttgtgcccatcaccaccctgggcccccacaactactgc

SEQ ID NO: 6432 - DNA, 63 bp, Artificial Sequence
  Synthetic oligonucleotide
gtgattctcgaccctgtcggaccggatggcaagaatcagctggggcagaagcgcgtggtcaag

SEQ ID NO: 6433 - DNA, 105 bp, Artificial Sequence
  Synthetic oligonucleotide
ggagagaagtcttttttcctccagccaggagagcagctggaacaaggcatccaggatgtgtatgtgctgtcggagcagcaggggctgctgctgagggccctgcag

SEQ ID NO: 6434 - DNA, 72 bp, Artificial Sequence
  Synthetic oligonucleotide
cccctggaggagggggaggatgaggagaaggtctcacaccaggctggggaccactggctcatccgcggaccc

SEQ ID NO: 6435 - DNA, 16 bp, Artificial Sequence
  Synthetic oligonucleotide
ctggagtatgtgccat

SEQ ID NO: 6436 - DNA, 89 bp, Artificial Sequence
  Synthetic oligonucleotide
ctgccaaagtggaggtggtggaggagcgccaggccatccctctagacgagaacgagggcatctatgtgcaggatgtcaagaccggaaag

SEQ ID NO: 6437 - DNA, 108 bp, Artificial Sequence
  Synthetic oligonucleotide
gtgcgcgctgtgattggaagcacctacatgctgacccaggacgaagtcctgtgggagaaagagctgcctcccggggtggaggagctgctgaacaaggggcaggaccct

SEQ ID NO: 6438 - DNA, 105 bp, Artificial Sequence
  Synthetic oligonucleotide
cgtggtcttcgggcctgagctggtgtcgctgggtcctgaggagcagttcacagtgttgtccctctcagctgggcggcccaagcgtccccatgcccgccgtgcgct

SEQ ID NO: 6439 - DNA, 67 bp, Artificial Sequence
  Synthetic oligonucleotide
ctgcctgctgctggggcctgacttcttcacagacgtcatcaccatcgaaacggcggatcatgccagg

SEQ ID NO: 6440 - DNA, 26 bp, Artificial Sequence
  Synthetic oligonucleotide
ctgcaactgcagctggcctacaactg

SEQ ID NO: 6441 - DNA, 40 bp, Artificial Sequence
  Synthetic oligonucleotide
gcactttgaggtgaatgaccggaaggacccccaagagacg

SEQ ID NO: 6442 - DNA, 6 bp, Artificial Sequence
  Synthetic oligonucleotide
gccaag

SEQ ID NO: 6443 - DNA, 39 bp, Artificial Sequence
  Synthetic oligonucleotide
ctcttttcagtgccagactttgtaggtgatgcctgcaaa

SEQ ID NO: 6444 - DNA, 85 bp, Artificial Sequence
  Synthetic oligonucleotide
gccatcgcatcccgggtgcggggggccgtggcctctgtcactttcgatgacttccataagaactcagcccgcatcattcgcactg

SEQ ID NO: 6445 - DNA, 19 bp, Artificial Sequence
  Synthetic oligonucleotide
ctgtctttggctttgagac

SEQ ID NO: 6446 - DNA, 52 bp, Artificial Sequence
  Synthetic oligonucleotide
ctcggaagcgaagggccccgatggcatggccctgcccaggccccgggaccag

SEQ ID NO: 6447 - DNA, 12 bp, Artificial Sequence
  Synthetic oligonucleotide
gctgtcttcccc

SEQ ID NO: 6448 - DNA, 8 bp, Artificial Sequence
  Synthetic oligonucleotide
caaaacgg

SEQ ID NO: 6449 - DNA, 38 bp, Artificial Sequence
  Synthetic oligonucleotide
gctggtggtcagcagtgtggacgtgcagtcagtggagc

SEQ ID NO: 6450 - DNA, 18 bp, Artificial Sequence
  Synthetic oligonucleotide
ctgtggatcagaggaccc

SEQ ID NO: 6451 - DNA, 19 bp, Artificial Sequence
  Synthetic oligonucleotide
gggacgccctgcaacgcag

SEQ ID NO: 6452 - DNA, 30 bp, Artificial Sequence
  Synthetic oligonucleotide
cgtccagctggccatcgagatcaccaccaa

SEQ ID NO: 6453 - DNA, 7 bp, Artificial Sequence
  Synthetic oligonucleotide
ctcccag

SEQ ID NO: 6454 - DNA, 14 bp, Artificial Sequence
  Synthetic oligonucleotide
gaagcggcggccaa

SEQ ID NO: 6455 - DNA, 34 bp, Artificial Sequence
  Synthetic oligonucleotide
gcatgaggctcagagactggagcaggaagcccgc

SEQ ID NO: 6456 - DNA, 24 bp, Artificial Sequence
  Synthetic oligonucleotide
ggccggcttgagcggcagaagatc

SEQ ID NO: 6457 - DNA, 45 bp, Artificial Sequence
  Synthetic oligonucleotide
ctggaccagtcagaagccgagaaagctcgcaaggaacttttggag

SEQ ID NO: 6458 - DNA, 14 bp, Artificial Sequence
  Synthetic oligonucleotide
ctggaggctctgag

SEQ ID NO: 6459 - DNA, 24 bp, Artificial Sequence
  Synthetic oligonucleotide
catggccgtggagagcaccgggac

SEQ ID NO: 6460 - DNA, 103 bp, Artificial Sequence
  Synthetic oligonucleotide
tgccaaggcggaggccgagtcccgtgcggaggcagcccggattgagggagaagggtccgtgctgcaggccaagctaaaagcacaggccttggccattgaaacg

SEQ ID NO: 6461 - DNA, 36 bp, Artificial Sequence
  Synthetic oligonucleotide
gaggctgagctccagagggtccagaaggtccgagag

SEQ ID NO: 6462 - DNA, 16 bp, Artificial Sequence
  Synthetic oligonucleotide
ctggaactggtctatg

SEQ ID NO: 6463 - DNA, 23 bp, Artificial Sequence
  Synthetic oligonucleotide
cccgggcccagctggagctggag

SEQ ID NO: 6464 - DNA, 18 bp, Artificial Sequence
  Synthetic oligonucleotide
gtgagcaaggctcagcag

SEQ ID NO: 6465 - DNA, 15 bp, Artificial Sequence
  Synthetic oligonucleotide
ctggctgaggtggag

SEQ ID NO: 6466 - DNA, 27 bp, Artificial Sequence
  Synthetic oligonucleotide
gtgaagaagttcaagcagatgacagag

SEQ ID NO: 6467 - DNA, 11 bp, Artificial Sequence
  Synthetic oligonucleotide
gccataggccc

SEQ ID NO: 6468 - DNA, 43 bp, Artificial Sequence
  Synthetic oligonucleotide
cagcaccatcagggaccttgctgtggctgggcctgagatgcag

SEQ ID NO: 6469 - DNA, 10 bp, Artificial Sequence
  Synthetic oligonucleotide
gtaaaactgc

SEQ ID NO: 6470 - DNA, 5 bp, Artificial Sequence
  Synthetic oligonucleotide
tccag

SEQ ID NO: 6471 - DNA, 102 bp, Artificial Sequence
  Synthetic oligonucleotide
tccctgggcctgaaatcaaccctcatcaccgatggctccactcccatcaacctcttcaacacagcctttgggctgctggggatggggcccgagggtcagccc

SEQ ID NO: 6472 - DNA, 11 bp, Artificial Sequence
  Synthetic oligonucleotide
ctgggcagaag

SEQ ID NO: 6473 - DNA, 267 bp, Artificial Sequence
  Synthetic oligonucleotide
tctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcag

SEQ ID NO: 6474 - DNA, 149 bp, Artificial Sequence
  Synthetic oligonucleotide
gtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaag

SEQ ID NO: 6475 - DNA, 256 bp, Artificial Sequence
  Synthetic oligonucleotide
gtgagtgcccaacatagcacagcaccctcatcacccctaattctgccaggagcccctccagatccccagcccctcttcagctcccttggcccccagtcctgcctggcctgggacccagagcagctccagctgccccaccagaagggaaggggcagagggacaggggtggctacagctccttggtcctgggcccaggaagccccgcccagggggctgcagtcttgcccccggccacagcctagactgcgggacacag

SEQ ID NO: 6476 - DNA, 164 bp, Artificial Sequence
  Synthetic oligonucleotide
ggactcgaagctggaggcaccagcagaggaggacgtgtgggagatcctacggcaggcacccccatctgagtacgagcgcatcgccttccagtacggcgtcactgacctgcgcggcatgctaaagaggctcaagggcatgaggcgcgatgagaagaagagcacag

SEQ ID NO: 6477 - DNA, 2144 bp, Artificial Sequence
  Synthetic oligonucleotide
gttagcccttcctcagaggggagaggagagggcacaggctagcccttccctacacaggagaggagagggcataggttagcccttccccacaggggagaggagagggcacaggttagccccccacctcgtccacatacatggaaagagcggagtccggcttagcacagagactcacaggaaagaagagcccaggttaacccctccttgtgtagaaaaagccaagaatgcccaggttagccccttaccacagagatagaagagaagagcaaaagttaggccaggacagccacaaggaaaaggacagagctcaggttaaccctcctcaccaaggaaaaatcaggctacactttctttctctaccctcttctgaaaagaaatgaagcccggttaaccctctccacacccaaaagaaaagggaagaggcccgctaagcctggagagccacacacaggcaaagaaaagagcctggctaatctttctctcaggcaaacaaagcaggagggcttgggttaactaccctcacccccaggcagatggaaagaggagagcccaggaatagcccttctccactgaggggttgacaagggcgggtgtgagccgggaaagcaggggtctcacatgccttctccccaccatgtctgggtctagcacagggcctggcacacacctcgagcgctctataaacaccgactgaatggaggggtcagcttccatgcaggatatgggagacaagcccctcccaaagcacacacacaaaacacacacgatcatggggacggggagaggagctggttagtccctccctgctgacctcccccaggccccttatccctctgccctgcctccctgttgtctcagcctcactgggtttcccatcaccccatcgctaggtggcctggcccttaccggcaccgtggccccatttaagccagggatcccctgaatgccaccaatgttcctctgggttaactcctgaactgctgagcccagagggcaccaagcaaaggactgtaggtgcccaaggaggaaaagatggaggctggcaaggcagatggggacctccgagggtaggggtgtcttccaggaatagcaacaacagtaaaaagagcaaattgctggccaggtgcagtggctcacgcctgtaatcccagcactttgggaggccgaggcaggtggatcacctgaggttaggcgttcaagaccagcctgaccaacatggtgaaaccccgtctctactaaaaatacaaaattacctgggcatggtggcaggcgcctgtaatcccagctactccggaggctgaggcaggagaatcacttgaacccgggaggcagaggttgcagtgagtcaggattgtgccattgcactccaacctgggtgacagaatgagactccatctcaaaaaaagtgagtgagttccttcctaagccagccactaggtgctttatgtaattatctcatttaattctcgaaacaacactatgatggaaggactattaccatttccatgttactgaggaaaccgaggcacagagggtttaaggaactagcgcaaggtcacagagcacccagcagtagatctctgcccctccgcagctgactccaggcccagccagagtatttgaggactcaggggtccttctctgctcggtggatggagcccccacttcctccctgggctcagcagcagcaacatgggcttttacaaacacggccgcaagaggaggcattgttgtggagcagggctgggctcaagacccagctctgccacacacctgctgggctggtggcattgggccagtcgcctctctgagccctatttcccccactgcagcagcatggggaccaccgcactggccctgggggctgagatgggagtgagagtgctgggcacagagggctgctaggtgggagcgcctgggaagagtacacaactcaggggttgctgagagaagagaaggcacagctgtcccagccccagttctcctgacaagcttctgtctttctggaagcccctaacccaatccctgagctgagcaggtggagaggaccccaaggaagacagaaggacaaggtcagacagacagagacaaggaggtgggttgacacatagacacagataaagaaatgaagacaccatgcctgt

SEQ ID NO: 6478 - DNA, 306 bp, Artificial Sequence
  Synthetic oligonucleotide
cagcactttgggaggctgaggcgggcgcatcacctgaggtcaggatttcaagaccagcccggccaacatggtaaaaccccgtctctactaaaaatacaaaaattagctgggcgtggtggcacatgcctgtaatcccagctactcgggaggccgaggcaggagaatcacttgaacctgggaggcagaggttgcagtgagccaagatggcgccattgcactccagcctggccaacagagcaagactctgtccaaaaaacaaacaaacagacaaacaaacaaaacaaaaagaaatagagacacagagaa

SEQ ID NO: 6479 - DNA, 127 bp, Artificial Sequence
  Synthetic oligonucleotide
gtggaagcggggcggcacagaggggattggagggggggacctgggccccagccacagccacagtagcttggcctgggggagcagggtgcgggcggtggggtggccggggctgaggggtggtgctcag

SEQ ID NO: 6480 - DNA, 128 bp, Artificial Sequence
  Synthetic oligonucleotide
caagtacatctttgagtccatcggtgccaagcgtaccctgaccatcagccagtgctcattggcggacgacgcagcctaccagtgcgtggtgggtggcgagaagtgtagcacggagctctttgtgaaag

SEQ ID NO: 6481 - DNA, 166 bp, Artificial Sequence
  Synthetic oligonucleotide
aaaagaagctggaggtgtaccagagcatcgcagacctgatggtgggcgcaaaggaccaggcggtgttcaaatgtgaggtctcagatgagaatgttcggggtgtgtggctgaagaatgggaaggagctggtgcccgacagccgcataaaggtgtcccacatcgggcg

SEQ ID NO: 6482 - DNA, 140 bp, Artificial Sequence
  Synthetic oligonucleotide
aacctcccaagatccacctggactgcccaggccgcataccagacaccattgtggttgtagctggaaataagctacgtctggacgtccctatctctggggaccctgctcccactgtgatctggcagaaggctatcacgcag

SEQ ID NO: 6483 - DNA, 160 bp, Artificial Sequence
  Synthetic oligonucleotide
ctgctgtgtgagaccgagggccgggtccgcgtggagaccaccaaggaccgcagcatcttcacggtcgagggggcagagaaggaagatgagggcgtctacacggtcacagtgaagaaccctgtgggcgaggaccaggtcaacctcacagtcaaggtcatcg

SEQ ID NO: 6484 - DNA, 298 bp, Artificial Sequence
  Synthetic oligonucleotide
gtgaggccggccggggtccaagctggagaacacagaggggcagccccaaggagggcccatccgttcgctcattcagccactcgacaaacatcacgggcatgctccctgagccgagcggcaacaggacaggtttttctgcccaaaaggagccccgctctgggggagatggaggcagatgcatccagcagatttcctgcgacactgctgtacatgagccatgtccagagtgccgtgggagcactgagcagagagccatccctgtgcctgggggtgatgcctttaggaggctgagaagatg

SEQ ID NO: 6485 - DNA, 189 bp, Artificial Sequence
  Synthetic oligonucleotide
gctacatcctggagcgcaagaagaagaagagctaccggtggatgcggctgaacttcgacctgattcaggagctgagtcatgaagcgcggcgcatgatcgagggcgtggtgtacgagatgcgcgtctacgcggtcaacgccatcggcatgtccaggcccagccctgcctcccagcccttcatgcctatcg

SEQ ID NO: 6486 - DNA, 135 bp, Artificial Sequence
  Synthetic oligonucleotide
gtccccccagcgaacccacccacctggcagtagaggacgtctctgacaccacggtctccctcaagtggcggcccccagagcgcgtgggagcaggaggcctggatggctacagcgtggagtactgcccagagggct

SEQ ID NO: 6487 - DNA, 168 bp, Artificial Sequence
  Synthetic oligonucleotide
gctcagagtgggtggctgccctgcaggggctgacagagcacacatcgatactggtgaaggacctgcccacgggggcccggctgcttttccgagtgcgggcacacaatatggcagggcctggagcccctgttaccaccacggagccggtgacagtgcaggagatcctgc

SEQ ID NO: 6488 - DNA, 196 bp, Artificial Sequence
  Synthetic oligonucleotide
ggcaagccccggcctcaggtgacctggaccaaagaggggcagcccctggcaggcgaggaggtgagcatccgcaacagccccacagacaccatcctgttcatccgggccgctcgccgcgtgcattcaggcacttaccaggtgacggtgcgcattgagaacatggaggacaaggccacgctggtgctgcaggttgttg

SEQ ID NO: 6489 - DNA, 140 bp, Artificial Sequence
  Synthetic oligonucleotide
acaagccaagtcctccccaggatctccgggtgactgacgcctggggtcttaatgtggctctggagtggaagccaccccaggatgtcggcaacacggagctctgggggtacacagtgcagaaagccgacaagaagaccatg

SEQ ID NO: 6490 - DNA, 160 bp, Artificial Sequence
  Synthetic oligonucleotide
gagtggttcaccgtcttggagcattaccgccgcacccactgcgtggtgccagagctcatcattggcaatggctactacttccgcgtcttcagccagaatatggttggctttagtgacagagcggccaccaccaaggagcccgtctttatccccagaccag

SEQ ID NO: 6491 - DNA, 137 bp, Artificial Sequence
  Synthetic oligonucleotide
gcatcacctatgagccacccaactataaggccctggacttctccgaggccccaagcttcacccagcccctggtgaaccgctcggtcatcgcgggctacactgctatgctctgctgtgctgtccggggtagccccaag

SEQ ID NO: 6492 - DNA, 134 bp, Artificial Sequence
  Synthetic oligonucleotide
cccaagatttcctggttcaagaatggcctggacctgggagaagacgcccgcttccgcatgttcagcaagcagggagtgttgactctggagattagaaagccctgcccctttgacgggggcatctatgtctgcag

SEQ ID NO: 6493 - DNA, 190 bp, Artificial Sequence
  Synthetic oligonucleotide
gtgaggagccctcggggccagggcctgggagatgggaagagcgggcggcagtggggaccctgggctttgctccgttgtcctcggccaagcacctgccctggctgcaagggcacggaccctgccacgcccagatgggcaatagcttccagaaggctgggaggacacagtgacatggcctcctcttctgcag

SEQ ID NO: 6494 - DNA, 321 bp, Artificial Sequence
  Synthetic oligonucleotide
gtacaaccggatgccagccccgtgccaggagcctggagggaagttggggaaacccctccctactgttggatgtatgtgtgacaagtgtgtctcctgtgctgcgatgggggatcagcagggcagttgtcgggcagtcctgagtgggtgttgcacagactggtccacagggctcctgaaggaagcccctggatctttggggtaaaaggagggtggcctcaagaaacaatgtctggggacaggcctttctggcctgctatgtcttcccaatgtttattgggcaataaaagataagtgcagtcacagagaactcactcttctcaa

SEQ ID NO: 6495 - DNA, 65 bp, Artificial Sequence
  Synthetic oligonucleotide
agtccctctttgggtgacctgtgcctgcttcgtgcctggtgtgacgtctctcaggatgcctgagc

SEQ ID NO: 6496 - DNA, 15 bp, Artificial Sequence
  Synthetic oligonucleotide
cggggaagaagccag

SEQ ID NO: 6497 - DNA, 114 bp, Artificial Sequence
  Synthetic oligonucleotide
agaaggcagagcccatgctggcccctgcccctgcccctgctgaggccactggagcccctggagaagccccggccccagccgctgagctgggagaaagtgccccaagtcccaaag

SEQ ID NO: 6498 - DNA, 99 bp, Artificial Sequence
  Synthetic oligonucleotide
ggtcaagctcagcagctctcaatggtcctacccctggagcccccgatgaccccattggcctcttcgtgatgcggccacaggatggcgaggtgaccgtgg

SEQ ID NO: 6499 - DNA, 118 bp, Artificial Sequence
  Synthetic oligonucleotide
gtctatctgttcgagctgcacatcaccgatgcccagcctgccttcactggcagctaccgctgtgaggtgtccaccaaggacaaatttgactgctccaacttcaatctcactgtccacg

SEQ ID NO: 6500 - DNA, 49 bp, Artificial Sequence
  Synthetic oligonucleotide
aggccatgggcaccggagacctggacctcctatcagccttccgccgcac

SEQ ID NO: 6501 - DNA, 30 bp, Artificial Sequence
  Synthetic oligonucleotide
gagcctggctggaggtggtcggcggatcag

SEQ ID NO: 6502 - DNA, 54 bp, Artificial Sequence
  Synthetic oligonucleotide
tgatagccatgaggacactgggattctggacttcagctcactgctgaaaaagag

SEQ ID NO: 6503 - DNA, 3 bp, Artificial Sequence
  Synthetic oligonucleotide
aga

SEQ ID NO: 6504 - DNA, 18 bp, Artificial Sequence
  Synthetic oligonucleotide
cagtttccggaccccgag

SEQ ID NO: 6505 - DNA, 61 bp, Artificial Sequence
  Synthetic oligonucleotide
cctttcagaagaagctggagccggcctaccaggtgagcaaaggccacaagatccggctgac

SEQ ID NO: 6506 - DNA, 72 bp, Artificial Sequence
  Synthetic oligonucleotide
cgtggaactggctgaccatgacgctgaggtcaaatggctcaagaatggccaggagatccagatgagcggcag

SEQ ID NO: 6507 - DNA, 106 bp, Artificial Sequence
  Synthetic oligonucleotide
agccccctgtgctcatcacgcgccccttggaggaccagctggtgatggtggggcagcgggtggagtttgagtgtgaagtatcggaggagggggcgcaagtcaaatg

SEQ ID NO: 6508 - DNA, 71 bp, Artificial Sequence
  Synthetic oligonucleotide
gctgaaggacggggtggagctgacccgggaggagaccttcaaataccggttcaagaaggacgggcagagac

SEQ ID NO: 6509 - DNA, 96 bp, Artificial Sequence
  Synthetic oligonucleotide
accacctgatcatcaacgaggccatgctggaggacgcggggcactatgcactgtgcactagcgggggccaggcgctggctgagctcattgtgcagg

SEQ ID NO: 6510 - DNA, 107 bp, Artificial Sequence
  Synthetic oligonucleotide
ggtccacaaactgaccattgacgacgtcacacctgccgacgaggctgactacagctttgtgcccgagggcttcgcctgcaacctgtcagccaagctccacttcatgg

SEQ ID NO: 6511 - DNA, 30 bp, Artificial Sequence
  Synthetic oligonucleotide
aggtcaagattgacttcgtacccaggcagg

SEQ ID NO: 6512 - DNA, 9 bp, Artificial Sequence
  Synthetic oligonucleotide
gggaataag

SEQ ID NO: 6513 - DNA, 72 bp, Artificial Sequence
  Synthetic oligonucleotide
gccccagccaggccagccccagatgccccagaggacacaggtgacagcgatgagtgggtgtttgacaagaag

SEQ ID NO: 6514 - DNA, 37 bp, Artificial Sequence
  Synthetic oligonucleotide
ctgacttggatctcaccccaactctgcacccccccag

SEQ ID NO: 6515 - DNA, 105 bp, Artificial Sequence
  Synthetic oligonucleotide
acgtgccagacgcacctgcggcccccaagatcagcaacgtgggagaggactcctgcacagtacagtgggagccgcctgcctacgatggcgggcagcccatcctgg

SEQ ID NO: 6516 - DNA, 89 bp, Artificial Sequence
  Synthetic oligonucleotide
aacggccacggcttcagctgcccaggcacctgcgccagaccattcagaagaaggtcggggagcctgtgaaccttctcatccctttccag

SEQ ID NO: 6517 - DNA, 53 bp, Artificial Sequence
  Synthetic oligonucleotide
ggccaccaacttacagggcgaggcacggtgtgagtgccgcctggaggtgcgag

SEQ ID NO: 6518 - DNA, 37 bp, Artificial Sequence
  Synthetic oligonucleotide
tgcctcagtgaccaggctggctcctggggatggccag

SEQ ID NO: 6519 - DNA, 125 bp, Artificial Sequence
  Synthetic oligonucleotide
ggagggaggcacaggcgcttgctttgcaggagtcagctctgccttcctcggctggagtgtgggtggcttggtgagccggtggtcaggaattctctctcctccttgcaattttcctttctgtctgg

SEQ ID NO: 6520 - DNA, 156 bp, Artificial Sequence
  Synthetic oligonucleotide
gcgagcttccacccaggcatcttcccagaagtccttgagtcagcggtcgtcttcacagagagcctccagccagacgtccctgggaggaaccatctgcagggtctgtgcgaagcgagtgagcacgcaggaagatgaggagcaggagaacagaagcag

SEQ ID NO: 6521 - DNA, 139 bp, Artificial Sequence
  Synthetic oligonucleotide
gtaccagtccctggtggccgcctatggtgaggccaagcgacagcgcttcctcagcgagctggcccacttggaggaggatgtccacctggcacgctcccaggcccgcgacaagctggacaaatacgccattcagcagatg

SEQ ID NO: 6522 - DNA, 158 bp, Artificial Sequence
  Synthetic oligonucleotide
atggaggacaagctggcctgggagagacacacatttgaagagcggataagcagggctcctgagatcctggtgcggctgcgatcccacaccgtctgggagaggatgtctgtgaaactctgcttcaccgtgcaaggatttcccacgcccgtggtgcagtg

SEQ ID NO: 6523 - DNA, 165 bp, Artificial Sequence
  Synthetic oligonucleotide
tgcccctgtcatcgatgattccgtacacgcacttcgacgtccagtttttggagaagtttggggtcaccttcaggagggaaggcgagacggtcactctcaagtgcaccatgctggtgacgccggacctgaagcgggtgcagccgcgcgccgagtggtaccgcgatg

SEQ ID NO: 6524 - DNA, 162 bp, Artificial Sequence
  Synthetic oligonucleotide
acgtgctgttgaaagagtccaagtggacgaagatgttctttggagaaggccaggcctccctgtccttcagccacctgcacaaggacgacgagggcctgtacaccctgcgcatcgtgtctcggggcggcgtcagcgaccacagcgccttcctgtttgtcagag

SEQ ID NO: 6525 - DNA, 142 bp, Artificial Sequence
  Synthetic oligonucleotide
atgctgacccgctggtcacaggggcccccggtgcacccatggacttgcagtgccacgacgccaaccgggactacgtcatcgtgacctggaagccgcccaacaccaccactgagagccccgtcatgggctattttgtggaccg

SEQ ID NO: 6526 - DNA, 200 bp, Artificial Sequence
  Synthetic oligonucleotide
atgtgaagtaggaacgaataattgggtgcagtgcaatgatgcaccggtgaaaatctgcaaatacccggtcacagggctttttgaaggaaggtcttacatattccgagtgagggcagtgaacagtgcgggcatcagccgaccctccagggtctctgatgcggtggctgcacttgaccccttggacctcagaaggttacaag

SEQ ID NO: 6527 - DNA, 184 bp, Artificial Sequence
  Synthetic oligonucleotide
tcggtggtggggagcggcagctggcagagagtcaacgcccagacggctgtgagatccccgagatatgccgtgtttgacctcatggaagggaagtcttatgtgttccgagtgctgtcagcaaaccggcatggcctgagcgaaccttcggagataacgtcccccattcaggcccaggatgtgaccg

SEQ ID NO: 6528 - DNA, 175 bp, Artificial Sequence
  Synthetic oligonucleotide
ttgtcccttctgctccgggtcgggttcttgcttcccgaaacaccaagacgtcggtggtggtgcagtgggaccgacctaagcatgaggaggacctgctgggctactacgtggactgctgtgtggccggaaccaacctctgggagccctgcaaccacaagcccatcggatacaacag

SEQ ID NO: 6529 - DNA, 122 bp, Artificial Sequence
  Synthetic oligonucleotide
gttcgtggtgcacggcttaaccacgggagagcagtacatcttccgagtcaaggcggtcaatgctgtggggatgagtgaaaattcccaggaatcagacgtcataaaagtgcaggccgcactca

SEQ ID NO: 6530 - DNA, 188 bp, Artificial Sequence
  Synthetic oligonucleotide
ccgtcccgtcccatccttatgggattacgctcctcaactgtgacggccactccatgaccctcggctggaaggtcccgaaattcagtggtggctcgcccatcctgggctactacctggacaagcgtgaagttcaccataaaaactggcacgaggtcaattcctcacccagcaaaccgacaatcctaacg

SEQ ID NO: 6531 - DNA, 179 bp, Artificial Sequence
  Synthetic oligonucleotide
gtcctgcctacgacttgacgttctgtgaggtcagggacacgtccttggtcatgctgtggaaggcccctgtgtactccggcagcagccctgtttctggatatttcgtggacttcagggaggaggatgctggagagtggatcactgtcaatcagacgacaacagccaaccgttatttaaag

SEQ ID NO: 6532 - DNA, 157 bp, Artificial Sequence
  Synthetic oligonucleotide
gcaccaaggaaatcagtgctggtgtcgatgaacaaggcaacatctatctgggcttcgactgccaggaaatgacagacgcgtctcagttcacctggtgtaaatcctacgaggagatttcagatgatgagaggtttaaaattgaaaccgtgggggatca

SEQ ID NO: 6533 - DNA, 137 bp, Artificial Sequence
  Synthetic oligonucleotide
caattcctctgaaatcggaattagcttatgagatttttgataaggggcgggttcgcttctggctccaggctgagcacttatcaccagatgccagctaccgatttattattaacgacagagaagtctctgacagcgag

SEQ ID NO: 6534 - DNA, 145 bp, Artificial Sequence
  Synthetic oligonucleotide
atacacagaattaaatgtgacaaagctactggcattattgagatggtgatggatcgatttagtattgaaaatgaggggacctacactgtgcagattcatgatgggaaagccaaaagtcagtcttctctagttcttattggagatg

SEQ ID NO: 6535 - DNA, 347 bp, Artificial Sequence
  Synthetic oligonucleotide
agagatggtaactccagcagggcagtttcatatccaccgagagaaggagatttaggatacacatccagcagttaaaaccagcaggggctggcaagtagctgggtgtgggtgagagggaagtgtactggaggaccgagtgggtgtgatatttcttgagatcagcactgtacggggagggccaagttttagggttttgagaatacattcaatttcacaaagatttagttatatccgtggaatggtcagtaaggcataaccggctcacgacaggacatgtgaacctggcagcaatgggaaagtcatctggagcatgtggattcatgagatatcgtgtgtggattcatgag

SEQ ID NO: 6536 - DNA, 197 bp, Artificial Sequence
  Synthetic oligonucleotide
gctgccaaaggacagcctttagagacaggaacatcacaaacaattggggcattctggaaaattcagattgtcagaggagaagaggagaccagctccaggattattaagcagaaaccctcagagagttcagagggaaagcaagtgacttggtggcctctggcagggagggactttggagtgaagcgctgcgtggccgg

SEQ ID NO: 6537 - DNA, 151 bp, Artificial Sequence
  Synthetic oligonucleotide
ggcagtacctcggcgtgacgcggtgacgcagccgcaggcaggcagtacctcggcgtgacgccatgacgcagccggagagagcttcacgcacaccatctcttcgttcttcctgaactctgtcacggagggggcctttgtttatttatttttg

SEQ ID NO: 6538 - DNA, 164 bp, Artificial Sequence
  Synthetic oligonucleotide
agatgctaagatctcatccagtgagcatatgagaatcggggggagtgaagagatggcttggctgcagatatgtgagccgactgagaaggataaaggaaaatacacttttgagattttcgatggcaaagacaaccatcaacgctcccttgacctgtccggacaag

SEQ ID NO: 6539 - DNA, 1197 bp, Artificial Sequence
  Synthetic oligonucleotide
gtaagatttgtgtatttagttactatgatatcctgtgggcagttgagtcccagtcgttttggctgcatgtgggaatctgtatggaagcctgggtgacctaaagaaagagccattcctgggacagaagtgggaatttaagcaatgcagtatatggaggggtgggcattctcctaaaccagaaatgcatttataaacggactgtccagagtcatcggaaccccggatgaatttcggaaatcattattgtgagagttgaagaaagagaaaagaaacacgcaaagcagattaacagtcaaagacaggtttattttggagaataaacctgagtggggcttttggccgatttcggtcaggagcgctttcttttacagactaagggtatttaagggttctggctcaggctaggaaggtttctgtgtggaggagagttttattgtgaggttggaatacctctggttggaggggagcttatctcagggttggaatgtttttgattggagggcaggttatgccagggttggtatgtttctggtcggaggtgtcatttgtggtttatggccatgctgacattagcccttaagctgatgtttttgggctggacttaggcggtttctaatcaaggaagacttaaaatggcgatgctagtccaagatggcggtgctgctgctctgccagtcatcatcagggcagcacatcacacacagcaactttttaaggacaattcggggttttcaaatgcaccatcgagtcttcgcacatccgaagctgaccgcagtccttggcccatgctagcttatttaatgaacatttgttgactgggtgcagggatgagcaagatagatcagaaactgacaaattccgaaaatatctcaagtctccagtgcaatctagtgaatttgtgaaaaaaaaaaaaatctcttcaacctgtgagctggaatgctaaacttttctgtgggttttagcatctggataatagggcattttccacctcaaaatgggcagtgggaaccatcaggaaaaatcagtgatatccatcctggggtcctgtgacccgaacatgttcttctaagagaatgcaaacgtatctccttcttcttttgcttcatcgctagtgagcctctcagctgtgcattttgttggaagcattttctcatactctcttttcattctctcctttctgtcccctttaacttttag

SEQ ID NO: 6540 - DNA, 503 bp, Artificial Sequence
  Synthetic oligonucleotide
ggcacccgccatcatgcccggctaatttttgtatttttagtagagacagggtttcatcatgttggccaggctggtctctaactcctgacctcagatgatctgcccgccttggcctcccaaagtgttgggattacaggcgtgagccactgcgcctggccaggaccccgtcactttctgcccaactcagggacacacgcggctctccaggccttccgtcctcggtgaattcttcacccttcaagcccagttcccatctcacatttcctctggagtgtttctcccccaaccccttcacagagtctgttatctcctcatctaccttcccttggctttggtttatccctcaactgtaaacatataaatctttttctttgatgctcgctctctcctgagcataaactcctcaccacattcaccttggtacccactgctgcttacatggctcctgctccgtgggaacgtcccgcagatgttttcctaaccaaggtgctttcccgttgcag

SEQ ID NO: 6541 - DNA, 754 bp, Artificial Sequence
  Synthetic oligonucleotide
cccgaagtgatttggttcaagaacgaccaggacatccagctcagcgagcacttctcggtgaaggtggagcaggccaagtacgtcagcatgaccatcaaaggcgtgacctccgaggactcgggcaagtacagcatcaacatcaagaataagtatggcggggagaagatcgacgtgacagtgagcgtgtacaaacacggggagaagatcccggacatggccccgccccagcaagccaagcccaagctcatccccgcgtctgcctcagcggcaggccagtgaaggcgttttcctagcctggagatgggaaaatatgcttggcagagacaggaatgctgtgtgcttgttccaaatgagcagctggcatccgagtggtgtcctgtgtgggctgatagttgatcacacattgtgcttttgatttttgcatttggtgatgaatattttatacccgtctaagggagaaagctaatgttttccacaagactgaacaacgtgtatttacacgagggtagacggcagatgcctgacagagagtgggttggcagacaacacactagcattttcacgggtgtgggcacatgggtgtggcacctggacgtgtgcagcatgtggcggtctgtgtgaagccaccgtgcttctctttggggggccgcgagatctagcatctctgaaatcctggctgtcgaggctttgaagcatgtgttacctggttaagcttgttttctcttgctttaggcaaataaaagtttaaaaatca

SEQ ID NO: 6542 - DNA, 393 bp, Artificial Sequence
  Synthetic oligonucleotide
ttttccagctttattctttttgtttgagaagcagcaatgttccttccagctttctgcaccctgggtagaagccggaagctccccaagcagcagactcgcatgcccataggtgatgtctgtgacgcgccacatccaaacgaagagatatcgttggaagacttgaatctagctggaaggccaatgttcttttcaatgtaatgccaaagaaaattcacacttgtttgttctgtagaaaaaagtgacataatattatttttatttttaaatttacttatagtcatatgtgcatgcctgctcaaaaatgctcacccatcatttgcataagtaaatcagtttgtatttaatgttacagtttaagactcatgtttcagaaatacaatttttattaactga

SEQ ID NO: 6543 - DNA, 119 bp, Artificial Sequence
  Synthetic oligonucleotide
gagcacgccaagatgtcccttgtgactgtccccttctaccagaagagacataggcacttcgaccagtcctaccgtaatattcaaacacggtacctgctggacgaatatgcgtcaaaaaa

SEQ ID NO: 6544 - DNA, 93 bp, Artificial Sequence
  Synthetic oligonucleotide
gtacaaagatggcagtctgatttgccaggcggctgaaccgggaaagtacaggattgagagcaactatggcgtacacacactggagatcaacag

SEQ ID NO: 6545 - DNA, 89 bp, Artificial Sequence
  Synthetic oligonucleotide
ggcagactttgacgacactgcgacatactcagcagtggccaccaatgcccacggacaagtgtccaccaacgcggcggtggtggtgagaa

SEQ ID NO: 6546 - DNA, 51 bp, Artificial Sequence
  Synthetic oligonucleotide
ggttccggggagacgaggaaccattccgttcggtgggactcccgattggat

SEQ ID NO: 6547 - DNA, 54 bp, Artificial Sequence
  Synthetic oligonucleotide
ccgttcatttggagggagagaaggagattgccatttatcaggatgaccttgaag

SEQ ID NO: 6548 - DNA, 101 bp, Artificial Sequence
  Synthetic oligonucleotide
gtgacgcccaggttccagggcctcccaccggtgtgcacgcttccgagatcagcagaaactatgtcgtcctcagctgggagccacccactccccgtggcaag

SEQ ID NO: 6549 - DNA, 27 bp, Artificial Sequence
  Synthetic oligonucleotide
gacccgctcatgtacttcattgagaag

SEQ ID NO: 6550 - DNA, 99 bp, Artificial Sequence
  Synthetic oligonucleotide
gtggacggcttgacggaaggctcactctacgagttcaaaatcgccgccgtcaacctggccggcatcggggagccctcagatcccagtgagcacttcaag

SEQ ID NO: 6551 - DNA, 28 bp, Artificial Sequence
  Synthetic oligonucleotide
tgtgaggcctggaccatgccggagcccg

SEQ ID NO: 6552 - DNA, 115 bp, Artificial Sequence
  Synthetic oligonucleotide
gtctctgacctgcagcaaggtaagacctatgtcttcagggtccgggcagtcaatgcaaatggcgtggggaagccctcagacacgtcggagcctgtgctggtagaggcgagaccag

SEQ ID NO: 6553 - DNA, 101 bp, Artificial Sequence
  Synthetic oligonucleotide
ctccaagctgtacttaaagaatccggataaggaggatttagggacttactccgtgtctgtaagtgatacagacggagtgtcctccagttttgttctggacc

SEQ ID NO: 6554 - DNA, 6 bp, Artificial Sequence
  Synthetic oligonucleotide
cagaag

SEQ ID NO: 6555 - DNA, 45 bp, Artificial Sequence
  Synthetic oligonucleotide
agctcgagcgtttgatggcattgagcaatgaaataaagaacccca

SEQ ID NO: 6556 - DNA, 60 bp, Artificial Sequence
  Synthetic oligonucleotide
cattcaagactgtgctggaagaggctgagtttcaaaggaaagaatttctcaggaaacaag

SEQ ID NO: 6557 - DNA, 68 bp, Artificial Sequence
  Synthetic oligonucleotide
gccctcattttgctgagtacttgcactgggatgtcacggaagaatgtgaagttcgacttgtttgcaag

SEQ ID NO: 6558 - DNA, 114 bp, Artificial Sequence
  Synthetic oligonucleotide
gttgcaaacaccaagaaagaaaccgttttcaaatggctcaaggatgatgttctgtatgaaacggagacactgcctaacctggagaggggaatctgtgagctcctcatcccaaag

SEQ ID NO: 6559 - DNA, 88 bp, Artificial Sequence
  Synthetic oligonucleotide
ttgtcaaagaaggaccacggtgaatacaaggcaaccttgaaagatgacagaggccaagatgtgtccatccttgaaatagctggcaaag

SEQ ID NO: 6560 - DNA, 39 bp, Artificial Sequence
  Synthetic oligonucleotide
tgtatgatgatatgattttggcaatgagtagagtctgtg

SEQ ID NO: 6561 - DNA, 106 bp, Artificial Sequence
  Synthetic oligonucleotide
ggaaatctgcttcgccactgaaggtactctgcaccccagaaggaatacgacttcagtgtttcatgaagtattttacagacgaaatgaaagtgaactggtgtcacaa

SEQ ID NO: 6562 - DNA, 37 bp, Artificial Sequence
  Synthetic oligonucleotide
cttttgatgaagcatttgcagaattccagcaattcaa

SEQ ID NO: 6563 - DNA, 23 bp, Artificial Sequence
  Synthetic oligonucleotide
agctgctgcttttgcagagaaga

SEQ ID NO: 6564 - DNA, 56 bp, Artificial Sequence
  Synthetic oligonucleotide
atcgtggcaggttgatcggcggcttgcctgacgtggtgaccatcatggaagggaag

SEQ ID NO: 6565 - DNA, 39 bp, Artificial Sequence
  Synthetic oligonucleotide
accttgaatctgacctgcacggtgtttggaaaccctgac

SEQ ID NO: 6566 - DNA, 235 bp, Artificial Sequence
  Synthetic oligonucleotide
ttcctgggatggctctagggagggttatttacactgtgagtgaggaggcattcacagagaagttcctccagagtgtggaagaagcactaccatttggcaccaacgcctggagaacaaaggaggagaccattggccaaagagaggcatttccattttgttggaacctgctgaccaccaacccatagcattttttccctttcttccttgctaatccaatcgcagattcattgaggag

SEQ ID NO: 6567 - DNA, 174 bp, Artificial Sequence
  Synthetic oligonucleotide
gtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgct

SEQ ID NO: 6568 - DNA, 1148 bp, Artificial Sequence
  Synthetic oligonucleotide
catgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagcagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgt

SEQ ID NO: 6569 - DNA, 145 bp, Artificial Sequence
  Synthetic oligonucleotide
tgctcttaaagttccgtacagataaaggaagagatcccagttctgatacatatgaggaagattctgagttgttgctccagatacgaaatgatgtgcttgactcactgggtattagtcctgacctgcttcctgaggactttgtcag

SEQ ID NO: 6570 - DNA, 202 bp, Artificial Sequence
  Synthetic oligonucleotide
ctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacag

SEQ ID NO: 6571 - DNA, 615 bp, Artificial Sequence
  Synthetic oligonucleotide
ccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctat

SEQ ID NO: 6572 - DNA, 80 bp, Artificial Sequence
  Synthetic oligonucleotide
ggccgaggggaggcggaaatagccgaaaggagctgagcaggagcgaggaggcgacgggggagagccagaaagagctgaag

SEQ ID NO: 6573 - DNA, 94 bp, Artificial Sequence
  Synthetic oligonucleotide
gaaggaggagaaactgagacggtccggaaagagccgaaagcggtgtccgggtgggtggcaggaggtggaaacagccgaaagaaaagcagccagg

SEQ ID NO: 6574 - DNA, 39 bp, Artificial Sequence
  Synthetic oligonucleotide
cgcatgcgcagaagcactccgggcgtgctgccggcggcg

SEQ ID NO: 6575 - DNA, 84 bp, Artificial Sequence
  Synthetic oligonucleotide
gtaggtggcgcgcgggtccggcgggcggttggcttgagcgggaccggagctgaggcaggaagagccggcgccatggtggagaag

SEQ ID NO: 6576 - DNA, 15 bp, Artificial Sequence
  Synthetic oligonucleotide
gaggaggctggcggc

SEQ ID NO: 6577 - DNA, 63 bp, Artificial Sequence
  Synthetic oligonucleotide
ggcattagcgaggaggaggcggcacagtatgaccggcagatccgcctgtggggactggaggcc

SEQ ID NO: 6578 - DNA, 8 bp, Artificial Sequence
  Synthetic oligonucleotide
cagaaacg

SEQ ID NO: 6579 - DNA, 78 bp, Artificial Sequence
  Synthetic oligonucleotide
acagggtctctctgtcgcgcagactagagtgcagtggtgtgatcacaactcacttcagccttgacttcttgggctcag

SEQ ID NO: 6580 - DNA, 29 bp, Artificial Sequence
  Synthetic oligonucleotide
gctgcgggcctctcgggtgcttcttgtcg

SEQ ID NO: 6581 - DNA, 83 bp, Artificial Sequence
  Synthetic oligonucleotide
gcttgaaaggacttggggctgaaattgccaagaatctcatcttggcaggagtgaaaggactgaccatgctggatcacgaacag

SEQ ID NO: 6582 - DNA, 33 bp, Artificial Sequence
  Synthetic oligonucleotide
gtgtgtctgacttgctgctccagggatgtcata

SEQ ID NO: 6583 - DNA, 15 bp, Artificial Sequence
  Synthetic oligonucleotide
gttaaagttgaccag

SEQ ID NO: 6584 - DNA, 62 bp, Artificial Sequence
  Synthetic oligonucleotide
atctgtcacaaaaatagcatcaagttctttacaggagatgtttttggctaccatggatacac

SEQ ID NO: 6585 - DNA, 33 bp, Artificial Sequence
  Synthetic oligonucleotide
atttgccaatctaggagagcatgagtttgtaga

SEQ ID NO: 6586 - DNA, 100 bp, Artificial Sequence
  Synthetic oligonucleotide
ggagaaaactaaagttgccaaagttagccaaggagtagaagatgggcccgacaccaagagagcaaaacttgattcttctgagacaacgatggtcaaaaag

SEQ ID NO: 6587 - DNA, 106 bp, Artificial Sequence
  Synthetic oligonucleotide
aaggtggtcttctgccctgttaaagaagccctggaggtggactggagcagtgagaaagcaaaggctgctctgaagcgcacgacctccgactactttctccttcaag

SEQ ID NO: 6588 - DNA, 82 bp, Artificial Sequence
  Synthetic oligonucleotide
gaaactgaaggtctgaccatctttggggagttgtgaagtcttgacagaggaggggagatctgagctgtatttctcggaacag

SEQ ID NO: 6589 - DNA, 23 bp, Artificial Sequence
  Synthetic oligonucleotide
gtactgcttctccgagatggccc

SEQ ID NO: 6590 - DNA, 47 bp, Artificial Sequence
  Synthetic oligonucleotide
cagtgtgtgcggtggttggagggattttggcacaggaaattgtgaag

SEQ ID NO: 6591 - DNA, 30 bp, Artificial Sequence
  Synthetic oligonucleotide
gccctgtctcagcgggaccctcctcacaac

SEQ ID NO: 6592 - DNA, 79 bp, Artificial Sequence
  Synthetic oligonucleotide
aacttcttcttcttcgatggcatgaaggggaatgggattgtggagtgccttggccccaagtgaactcaagatttggcag

SEQ ID NO: 6593 - DNA, 15 bp, Artificial Sequence
  Synthetic oligonucleotide
ccccagagatgccaa

SEQ ID NO: 6594 - DNA, 45 bp, Artificial Sequence
  Synthetic oligonucleotide
ctgcagcatgcccacctgtattccctgtccccttccttcatgaag

SEQ ID NO: 6595 - DNA, 15 bp, Artificial Sequence
  Synthetic oligonucleotide
gcatctccaggcaag

SEQ ID NO: 6596 - DNA, 61 bp, Artificial Sequence
  Synthetic oligonucleotide
gaaaactgaagtcattggcccgatacaaaacatttcctgcaacgaaggaggtggtgccgac

SEQ ID NO: 6597 - DNA, 4 bp, Artificial Sequence
  Synthetic oligonucleotide
gtgc

SEQ ID NO: 6598 - DNA, 61 bp, Artificial Sequence
  Synthetic oligonucleotide
tgcttcccatcaccagcagctgctcgacaaggggcgcagggtggctgtctttgttccagca

SEQ ID NO: 6599 - DNA, 27 bp, Artificial Sequence
  Synthetic oligonucleotide
ctgttcaggctgcctgtcatcccgggc

SEQ ID NO: 6600 - DNA, 7 bp, Artificial Sequence
  Synthetic oligonucleotide
ctgccag

SEQ ID NO: 6601 - DNA, 34 bp, Artificial Sequence
  Synthetic oligonucleotide
ctcccctgagtgatgagcacttccaagcacccct

SEQ ID NO: 6602 - DNA, 22 bp, Artificial Sequence
  Synthetic oligonucleotide
ctgccctttctctgtccttatg

SEQ ID NO: 6603 - DNA, 14 bp, Artificial Sequence
  Synthetic oligonucleotide
gtgcccttagagag

SEQ ID NO: 6604 - DNA, 44 bp, Artificial Sequence
  Synthetic oligonucleotide
gaaaaccatgacaggcaaatgcatttcctctggagtttgagacc

SEQ ID NO: 6605 - DNA, 61 bp, Artificial Sequence
  Synthetic oligonucleotide
ctgacaaacaacaggtggcatctggtgtgctgttcttgagttttcgtttaggattagttga

SEQ ID NO: 6606 - DNA, 7 bp, Artificial Sequence
  Synthetic oligonucleotide
gttccag

SEQ ID NO: 6607 - DNA, 53 bp, Artificial Sequence
  Synthetic oligonucleotide
ctgggttttgggagaaaggagatgctaccaagtcttggatgttagggcgagac

SEQ ID NO: 6608 - DNA, 19 bp, Artificial Sequence
  Synthetic oligonucleotide
cctgcaagttgagtattag

SEQ ID NO: 6609 - DNA, 9 bp, Artificial Sequence
  Synthetic oligonucleotide
agagcttgt

SEQ ID NO: 6610 - DNA, 12 bp, Artificial Sequence
  Synthetic oligonucleotide
ctttcaaggcag

SEQ ID NO: 6611 - DNA, 37 bp, Artificial Sequence
  Synthetic oligonucleotide
gttcctggggcttcagggctaggagggaggagcctgc

SEQ ID NO: 6612 - DNA, 252 bp, Artificial Sequence
  Synthetic oligonucleotide
agcagtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccg

SEQ ID NO: 6613 - DNA, 245 bp, Artificial Sequence
  Synthetic oligonucleotide
gtagggccctgcgcgcacggcgccagagggatgggcgggtagagccaactgcctctggttctgctggcctccgctgctcgcgaagggattcctgctcccgggaggtgtaggagccgctttccagaagcacagcccagagacgtctgggcggcggcccacacaacgcatgtgttcggagctcgccgcgctctgcttttgctctaagcgggaaccatggcttctggccacgctggggaaccgaggag

SEQ ID NO: 6614 - DNA, 1152 bp, Artificial Sequence
  Synthetic oligonucleotide
ccgaaagctaggagacagtcagggatctctaagttcccagtgagtaggaggcagaggtgaggtgtagaactcgtttttgcatgtctctcgcctctagacgcacccttccctcatcccatgccctcccacctccgcccctacattaaaggtagcattggatcccggggccgttcagtgaagctagcaggtgtccgcaggaactcccttccccctgccaggctagaaaccttacaaggctgtctagaaatagcagtgatttgtaaggagagacccggctccagcttggtgactctgggctgactgcctgcctagaggtcctctcggatttttgccctttggagtggtgtcaaaactagacgtgatactttggggatgcagcctgtgatatttcctccagcgaatgcagtgcagggttggattaacaaggtggaaagaattcgagggttccaccaagtagctattaactctagggctgcaggcctcaggccttctgcagctatttctacactccctgtactgaaactatttcttcatactgggcctgacaggcctttgcaacaaggatcacggccgaagccacaccgtgcgcctccctcccggttggttaacaggccctggtttctagtattgcgatttaaagtctggcgctggctgcgcgccagacctgggaggctgccagctaggcttcacgttgctggcgtctgcttcggggcattcattaggtctgaagtctgaatcccagctccctccctctcacccactgagctgcatagctccagattgcctctgcttacgggcggggcttctcagccttctgccttctggcccgatgcccgcttcccaacggccggaggccgctagactaatcggcttcgccctgcgcgctgtaatgcgcatgcgcacgcgcacaagttcctgggcccgcccatcttccggacttgggcggggcgtaaaagccgggcgttcggaggacccagcaattagtctgatttccgcccacctttccgagcgggaaggagagccacaaagcgcgcatgcgcgcggatcaccgcaggctcctgtgccttgggcttgagctttgtggcagttaatggcttttctgcacgtatctctggtgtttacttgagaagcctggctgtgtccttgctgtag

SEQ ID NO: 6615 - DNA, 131 bp, Artificial Sequence
  Synthetic oligonucleotide
gagccggagtagctcagagtgatcttgtctgaggaaaggccagccccacttggggttaataaaccgcgatgggtgaaccctcaggaggctatacttacacccaaacgtcgatattccttttccacgctaag

SEQ ID NO: 6616 - DNA, 150 bp, Artificial Sequence
  Synthetic oligonucleotide
attccttttggttccaagtccaatatggcaactctaaaggatcagctgatttataatcttctaaaggaagaacagaccccccagaataagattacagttgttggggttggtgctgttggcatggcctgtgccatcagtatcttaatgaag

SEQ ID NO: 6617 - DNA, 125 bp, Artificial Sequence
  Synthetic oligonucleotide
ttggcctcccaaagtgctgggattacaagcgtgagccaccgtgcctggcctggccaggctgtcttgaactcctgacctcaagtgatgtgcccgcctcggcctcccaaagtgttgggattacagat

SEQ ID NO: 6618 - DNA, 896 bp, Artificial Sequence
  Synthetic oligonucleotide
gttgatttcaacaagtttatattataatccatgcttgacttaaattctttttccagatggtctccatttgttgcttagggtagagtgcagttgcacaattatggctcaccacagcctcgaaccctgggctcaagcaatcctccttccacttcattaccccctccccctcacaaagaaactgggactatagggtatgctaccatgcccggctaatttttttactttttgtagagatggggacccactgtgttgcccaggcctgtcttgaaccactgggctcaagtgatcctccctccttagccttccgaagtactgggattgcaggtgtgaaccactgtgcccggctttagacttaagtgctttatcaggcttgaaatcctagctctttaaagattttgttttaaatgccgggtgcaagagcctgggaacaatttcacttaggtgcctgtgaatatcaaagtttcaatttctggcaaatggtttaaaatagaaatccaatttgtccatgctatgcaaaccatctgaattagaatgtaatgagtaaagcttaaaccttaggtctgtatttaaccacattgtgttacttacttgcccccacatcctttcacacacgaagttgagaatagggtaaataaatgagcctgttcagctaatactcttggcttgaccctttcacacttaacagcaccagccaagaaacctgaatgtgagcccaaatagtgtctattttgatacctgaaaatcactggccaccttgctgatgggcaactcccttcatcactggtttaactctcttgtgccatagggtatctagaagcaaaatatgttaagtgtaaagctgtctctgcttaaaaacaagtccccctaccaccaccaccacacacacacacacacac

SEQ ID NO: 6619 - DNA, 357 bp, Artificial Sequence
  Synthetic oligonucleotide
acgaaattgcctgttcctgggctgataggacaccagttaagtagaaacaggagtatggaagagtgtgaacgttgagcttggggatcaaaaaatttgaggatatgtaagaaattaataggagaatcaaataataaacttgatttcctccagctctccctaattgtagttacataaagttacaacttgactaaaactacaaggaagatgttgacatgctcttcctccatttaagaagccataatgataaaactctaagaacaagaaaggtttgtggagcatttatggaacaaatttttgctgcctaggtaaaatttattctaaaggccttaatctggtcattattccccttttctctag

SEQ ID NO: 6620 - DNA, 133 bp, Artificial Sequence
  Synthetic oligonucleotide
actataatgtaactgcaaactccaagctggtcattatcacggctggggcacgtcagcaagagggagaaagccgtcttaatttggtccagcgtaacgtgaacatctttaaattcatcattcctaatgttgtaaa

SEQ ID NO: 6621 - DNA, 305 bp, Artificial Sequence
  Synthetic oligonucleotide
cagtcctcccacctcagcctcccaaagtgttgggataacaggtgtgagttgtcatgcccagccaaaactactttttgaataattaatggacttgatatacatagtgtagaggcttaaaaatattaacaaaattattggttagccatgatcaatatcaagatcctgaaaagccatatatctggagtagcctattattatctaatgatcacctagtatctggttaagtgttttcttcatagtaggtatatcttttttgtgtgtagggagaggataatgggtgatttttattttctcctttttcatag

SEQ ID NO: 6622 - DNA, 334 bp, Artificial Sequence
  Synthetic oligonucleotide
gtaataaatctttcaatttggcaacacagaatattaacatttactatttttatttaaaaggttaaaattgtaatagtatttgcatttgagaactttttgttagaaaacttgtgtggtttttttgttttgttttgtttgagacagaatcttgccctttcgcacaggctgcagtgcagtggcgcaatcttggctcactgcaacctctgcctcccgggttcaggcgattctcctgcctcagcctcctgggtacctgggactacaggcatatgccatgacgcccggctaattttttgtatttttagtagagatggggtttcaccatgttagccaaaaa

SEQ ID NO: 6623 - DNA, 124 bp, Artificial Sequence
  Synthetic oligonucleotide
tgcttatgaggtgatcaaactcaaaggctacacatcctgggctattggactctctgtagcagatttggcagagagtataatgaagaatcttaggcgggtgcacccagtttccaccatgattaag

SEQ ID NO: 6624 - DNA, 134 bp, Artificial Sequence
  Synthetic oligonucleotide
tgcagatacactttgggggatccaaaaggagctgcaattttaaagtcttctgatgtcatatcatttcactgtctaggctacaacaggattctaggtggaggttgtgcatgttgtcctttttatctgatctgtga

SEQ ID NO: 6625 - DNA, 121 bp, Artificial Sequence
  Synthetic oligonucleotide
aattcttccaaaggatcttattttgtgaactatatcagtagtgtacattaccatataatgtaaaaagatctacatacaaacaatgcaaccaactatccaagtgttataccaactaaaaccc

SEQ ID NO: 6626 - DNA, 599 bp, Artificial Sequence
  Synthetic oligonucleotide
ccaataaaccttgaacagtgactactttggttaattcattatattaagatataaagtcataaagctgctagttattgtattaatttggaaatactaggctattcttgggcaaccctgcaacgattttttctaacagggatattattgactaatagcagaggatgtaatagtcaagtgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggtgcagtggctcatgcctataatcccagcactttgggaagcccaggtgggctgatcactggaggccaggaattggggaccagcctggccaacacaacaaaaccccatctgttaaaaaaacaaaacaaaaccaaaaaaaacaagtaaccttggtggatgtctactcaagttttctgtacatttttctgaaaatacaactgtgaccctta

SEQ ID NO: 6627 - DNA, 5 bp, Artificial Sequence
  Synthetic oligonucleotide
gtacg

SEQ ID NO: 6628 - DNA, 51 bp, Artificial Sequence
  Synthetic oligonucleotide
gacttggcagatgaacttgctcttgttgatgtcatcgaagacaaattgaag

SEQ ID NO: 6629 - DNA, 67 bp, Artificial Sequence
  Synthetic oligonucleotide
ggagagatgatggatctccaacatggcagccttttccttagaacaccaaagattgtctctggcaaag

SEQ ID NO: 6630 - DNA, 19 bp, Artificial Sequence
  Synthetic oligonucleotide
atacagcccgaactgcaag

SEQ ID NO: 6631 - DNA, 22 bp, Artificial Sequence
  Synthetic oligonucleotide
ttgcttattgtttcaaatccag

SEQ ID NO: 6632 - DNA, 29 bp, Artificial Sequence
  Synthetic oligonucleotide
tggatatcttgacctacgtggcttggaag

SEQ ID NO: 6633 - DNA, 49 bp, Artificial Sequence
  Synthetic oligonucleotide
ataagtggttttcccaaaaaccgtgttattggaagtggttgcaatctgg

SEQ ID NO: 6634 - DNA, 20 bp, Artificial Sequence
  Synthetic oligonucleotide
attcagcccgattccgttac

SEQ ID NO: 6635 - DNA, 9 bp, Artificial Sequence
  Synthetic oligonucleotide
ctgatgggg

SEQ ID NO: 6636 - DNA, 67 bp, Artificial Sequence
  Synthetic oligonucleotide
gaaaggctgggagttcacccattaagctgtcatgggtgggtccttggggaacatggagattccagtg

SEQ ID NO: 6637 - DNA, 9 bp, Artificial Sequence
  Synthetic oligonucleotide
tgcctgtat

SEQ ID NO: 6638 - DNA, 66 bp, Artificial Sequence
  Synthetic oligonucleotide
ggagtggaatgaatgttgctggtgtctctctgaagactctgcacccagatttagggactgataaag

SEQ ID NO: 6639 - DNA, 20 bp, Artificial Sequence
  Synthetic oligonucleotide
ataaggaacagtggaaagag

SEQ ID NO: 6640 - DNA, 23 bp, Artificial Sequence
  Synthetic oligonucleotide
gttcacaagcaggtggttgagag

SEQ ID NO: 6641 - DNA, 4 bp, Artificial Sequence
  Synthetic oligonucleotide
gtag

SEQ ID NO: 6642 - DNA, 60 bp, Artificial Sequence
  Synthetic oligonucleotide
ggtctttacggaataaaggatgatgtcttccttagtgttccttgcattttgggacagaat

SEQ ID NO: 6643 - DNA, 62 bp, Artificial Sequence
  Synthetic oligonucleotide
ggaatctcagaccttgtgaaggtgactctgacttctgaggaagaggcccgtttgaagaagag

SEQ ID NO: 6644 - DNA, 6 bp, Artificial Sequence
  Synthetic oligonucleotide
ttaaag

SEQ ID NO: 6645 - DNA, 77 bp, Artificial Sequence
  Synthetic oligonucleotide
cagtaatattttaagatggactgggaaaaacatcaactcctgaagttagaaataagaatggtttgtaaaatccacag

SEQ ID NO: 6646 - DNA, 7 bp, Artificial Sequence
  Synthetic oligonucleotide
ctatatc

SEQ ID NO: 6647 - DNA, 21 bp, Artificial Sequence
  Synthetic oligonucleotide
ctgatgctggatggtattaat

SEQ ID NO: 6648 - DNA, 81 bp, Artificial Sequence
  Synthetic oligonucleotide
cttgtgtagtcttcaactggttagtgtgaaatagttctgccacctctgacgcaccactgccaatgctgtacgtactgcatt

SEQ ID NO: 6649 - DNA, 58 bp, Artificial Sequence
  Synthetic oligonucleotide
tgccccttgagccaggtggatgtttaccgtgtgttatataacttcctggctccttcac

SEQ ID NO: 6650 - DNA, 72 bp, Artificial Sequence
  Synthetic oligonucleotide
tgaacatgcctagtccaacattttttcccagtgagtcacatcctgggatccagtgtataaatccaatatcat

SEQ ID NO: 6651 - DNA, 11 bp, Artificial Sequence
  Synthetic oligonucleotide
gtcttgtgcat

SEQ ID NO: 6652 - DNA, 821 bp, Artificial Sequence
  Synthetic oligonucleotide
gaaatgtggggctatggagcagcaaggagacacacaataaattttacagagaaacctgtacctctttgcagtcaaataaatcgactgacagaccctgaataaacacagcttaggttttcttagattgctcttatcctggctatccaagaatgttgcaacacctttaaattttaagattaagttgtcattgtcagttcttataacagattttcttactcttaagtttatgggagaggaggagaatataggataatgttaatttctctgccacacagctctgctttcttaataattcagactctctccatccagggaaaaaatgaatacctaatgtgagtatatggaatcctgacccagctttcagattgagagagtctatgaatcatcacatttgatgtttatgattcaaaatgtaggattgccttaaactaaggcaattaggaagatagtttttcagagacgttagtctttgttaagatttctaggtccccataagagcacttagtcagataattgctaaagcacatatgtggctctaggaactaaggaaaaagtaaatgccataggaagactattttttaaattacctcattcatcagtctattgtaagagacagcaaatttgaaactaaaggtcacaggctgctttagatgcatggacttaaaaattagagaaagtcatcaataaaacttagttcttattcattatagtcatttcatttaggaaatttccaaaaggtgaatggaatttttaagcccatgaaagatgaatttttgtcaccttggcctcagagtggctcagggtcagagaaggtagagaga

SEQ ID NO: 6653 - DNA, 194 bp, Artificial Sequence
  Synthetic oligonucleotide
taccatgcttctggcttcctccctgaaggagccttcacatgaactactgggctctgctacatgttaacctagaaaacctcccgagccaaatttcaaacgatacattttaacatgtgaaagaagacaccagctcataagatgtggaacaagaagaaagggacagtgccatgaaatctcaaagattctcaaagaat

SEQ ID NO: 6654 - DNA, 144 bp, Artificial Sequence
  Synthetic oligonucleotide
atggctgatgaagagtctcgcctttctgcttattataacctgctccactgcctacgcagggattcacataaaatcgacaattatctcaagctcctgaagtgccgaatcatccacaacaacaactgctaagcccacatccatttc

SEQ ID NO: 6655 - DNA, 147 bp, Artificial Sequence
  Synthetic oligonucleotide
atctatttctgagaaggtccttaatgatccgttccattgcaagcttcttttagttgtatctcttttgaatccatgcttgggtgtaacaggtctcctcttaaaaaataaaaactgactccttagagacatcaaaatctaaaatgaaga

SEQ ID NO: 6656 - DNA, 94 bp, Artificial Sequence
  Synthetic oligonucleotide
ctgacgtttctataaagtaggtcataagaaccttcattccagaagtaccctcaaagacagagacaccaagaagaatcggaacatacaggctttg

SEQ ID NO: 6657 - DNA, 14 bp, Artificial Sequence
  Synthetic oligonucleotide
gataaacggtatac

SEQ ID NO: 6658 - DNA, 36 bp, Artificial Sequence
  Synthetic oligonucleotide
ccatggccgggggttcattaccaaggccatcaacag

SEQ ID NO: 6659 - DNA, 24 bp, Artificial Sequence
  Synthetic oligonucleotide
ctgccacacttcttcccttgccac

SEQ ID NO: 6660 - DNA, 13 bp, Artificial Sequence
  Synthetic oligonucleotide
ccccgaagacaag

SEQ ID NO: 6661 - DNA, 21 bp, Artificial Sequence
  Synthetic oligonucleotide
gagcaagcccaacagatgaat

SEQ ID NO: 6662 - DNA, 4 bp, Artificial Sequence
  Synthetic oligonucleotide
caaa

SEQ ID NO: 6663 - DNA, 82 bp, Artificial Sequence
  Synthetic oligonucleotide
aagactttctgagcctgatagtcagcatattgcgatcctggaatgagcctctgtatcatctggtcacggaagtacgtggtat

SEQ ID NO: 6664 - DNA, 46 bp, Artificial Sequence
  Synthetic oligonucleotide
gcaagaagccccggaggctatcctatccaaagctgtagagattgag

SEQ ID NO: 6665 - DNA, 15 bp, Artificial Sequence
  Synthetic oligonucleotide
gagcaaaccaaacgg

SEQ ID NO: 6666 - DNA, 33 bp, Artificial Sequence
  Synthetic oligonucleotide
cttctagagggcatggagctgatagtcagccag

SEQ ID NO: 6667 - DNA, 63 bp, Artificial Sequence
  Synthetic oligonucleotide
gttcatcctgaaaccaaagaaaatgagatctaccctgtctggtcgggacttccatccctgcag

SEQ ID NO: 6668 - DNA, 246 bp, Artificial Sequence
  Synthetic oligonucleotide
gtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctg

SEQ ID NO: 6669 - DNA, 1369 bp, Artificial Sequence
  Synthetic oligonucleotide
tttattttcaattcctggtatttcttattagtatctggaaatacaaaaattgcattttgtgtatttacattacacattttgaatgttttgaaagaaaatattctgcttgaatagatggtgcacatatacctccaactgcatcttgacaatgttgacagacaactctgaacccgcagagccaagatcagtttcctttttatcactggaaatggttaacattttcaacttcacctctcatgtagtgaaggatcctgtggagagccaaatcagcactttgctaagaagaggaagaatattgtttgttttatttgctgaatatttatggcaacagtcagtgttccctttccccctcctcatgcatgttaattaatacaaatagatgcctgtgatgagcacctgctcttcagtttttagactcaactagattctaaaagccagtgggcccccaacaacatcaagttctgactatcccgggggaaattctccaagctcatagatgcctcactaattttcattacatttagatacaaagaactacctctttgctcagatcacctcaaagattgatgatattaaaattaattttcaggaatgtttccttatttgattgctatcatattagttccctttcccttccatgaacttatccacagttatcatttcctatatgttgtcagcaaaacctctgctattttctgggggaatagagattagctattttgactacctgtaaattcaacaaatgtgagttagacccatagtccatatgatgcaattgttggaaatagctctttgggaactgatagtgagttggcaaaagaactctattttttcaacaatacttacaaaagggaatttaaatgtaattgaaaaagctaactttgcatcagaagacctggttactgcttatgataactgtttcacagctagttataaaaactctccatactttcatctgtaaactgagataaaaattatacttcactaattgtgagattaaagatctagtaactggttttgagaatgtttgtgagtattcaaaagataatttgctcagtgcctgattcatttccagcagtaagtgcataatttctgttttcaaggaaatagatcaacttcctaaaacatcaaatcgagatactttggtcataatcaaagttttactcaaactttttaaggttttgccaaggaaggggtacaggaaaatcagtcagatacttttggaagattagagaaatcagaaagggtggggaatgaaagagcctagtaaagaagtcacagtctgcaatgaaagcagagaattctgatgaagaatagatctgacttctttcatttaggacccaacttaccatatctgatttatttctag

SEQ ID NO: 6670 - DNA, 655 bp, Artificial Sequence
  Synthetic oligonucleotide
gtgagtacaaacttgagtttcttttaaactatatattttaagttagttatcttcaagtgtactgataatatgaatctcaccccgagaaaagcaaactatttactttttccaaaaacagttatctctttcttattctcccttttatatatttagcattaaatattattttttagaagtcacttgtatgataaaagcctatattttttacagcaaaatagtcgatagcttggatttttataaagtacacacaaaatacctttaattaaaaaaattattagtggttgcaatgattgtgttttttaaagccctcagttatgcaaatataaattgtatagattatataaccaaaaatatatttttacttatggatatgaaagccagtttcagtaaagcttcatttcctcagtgaccataagtaggtgatgtgatacagagaaatagattcaacacagatttcctatctcactcagcaactgaaaccttagcatgtctcaagcatcatgctaatattccctgtcttacttgtgcttatgactaagaaaacatcatgagcatgtataggatggcttcttataacttggggcaaatgccagaagatgaggtgtaaataaagtgcaacaggagtgaagcagagatacatattttttattaaaag

SEQ ID NO: 6671 - DNA, 1908 bp, Artificial Sequence
  Synthetic oligonucleotide
gggccaagaaaggatccatgaaaagaatagaatgccagccgggtgcagtggctcactcctgtaatcccagcactttgggaggccgatgcaggtggatcacctgagaccagcctggccaacatggtgaaaccccatggtggcgggcgcctataataccagctactcaggaggctgaggcagaagaatcgcttcaatctgggaggcagaggttgcagtgagctgagattgtgccactgcactccaacctgggtgacaagagtgagactccatcttaaaaaaaaggaaaaaaaaagaatagaatgccatttaaatagagttctgaattttggcaatatcaaaagagcatgccaggttaaataaaggtgtggaatgaacaaagcaaataaaagggattccacgagtgactttagtttttctgagattgacttgatattaaagactttgactcaggctcaaatgactgtgtaaatttccattatattctactgcataaattcccttttctgtaatgcaaaccttcttcttgggctgttttaaaccattttggaaaattctcagagtttagcaagtattgtggaaataggacctctggatgagaggtctaatatcctgaagttttagacccaaaacattaggtattctactttgtaataaatctgtttccataattaagacttgtaaaaagaatttgaagccacctgttagttttctcatgacccatgttcttgacattaagctcaaacatcatatttccatccaatgggaggagaaagcaagagaacaacagctttgagacttgggaaatttccaagtgccgctcaacatttacagtgaaacattagaaaaatattagtagagggctggaacaccctatctgcttagcctctgaaacctccgagtttctgcttattctttctatttgttcaaaactatgtaaatatgggaggcacatttgtatgctagaaaacatgacctctcttcctatatttctcagataagaaaatttaggtctagagacaaaatgttgctttctcaaatacaacatatttcctaatgtatgacattgcctttttcactgttgattaaaagtaccaaacttattacctagtaactaaagccagacgctgaccctagtttgagacaagtagataataccaaacaagggcttgcaaatcagtctttttggtgattatgtgcttggcaaatatattcaataaacactttttctattccttctacgtcttcatagggaatctgtaccggcaaattcttttccataaacctgcatctccaatagaaccttctataatgatggaaatgttctatgtttatgctgtctaatacatagccactagccacaaaacagtagccttaatgtggctaacactaacttaaatgtggctagtaaaactgatcagctgaatatttaatattatctaaactaatttacatttacatagctatatgtggatagtgaatatatgaaactagagtgaacagcatagcaactcttgtttattctgtttaggtgtgtgtgcttatgtatgctaactgatttggaaatcagtattaatgagcagttaatgattgtgggacaagaaagcattaaaaaatcttaaagagtttggctgggcatggtggctcatgcctgtaatcccagcactttggaagtcccaggcaggtggatcacttttgttaggagtttgagaccagcctggccaacatggtaaaaccccgtctctactaaaaatacaaatattagccaggcatggtggcattcacctgtaatcccagctacttgggaggctgaggcaggagaatcacttgaacccgggaggtggaggctgcagtgagccaaggtcacaccactgcactccagcctgggcaacagagtgagactctgtctta

SEQ ID NO: 6672 - DNA, 108 bp, Artificial Sequence
  Synthetic oligonucleotide
cacaaggtctgatagttttataagggacttttctcccttttgctcaatacttctccttgctgctgccatgtgaagaaggatgtgtttgcttctccttctgccatgatt

SEQ ID NO: 6673 - DNA, 32 bp, Artificial Sequence
  Synthetic oligonucleotide
gtaacactggagctgactccctgggaagagag

SEQ ID NO: 6674 - DNA, 70 bp, Artificial Sequence
  Synthetic oligonucleotide
gccaaatgttacaatgaacttaatggatgcaccaagatatatgaccctgtctgtgggactgatggaaata

SEQ ID NO: 6675 - DNA, 12 bp, Artificial Sequence
  Synthetic oligonucleotide
cttatcccaatg

SEQ ID NO: 6676 - DNA, 25 bp, Artificial Sequence
  Synthetic oligonucleotide
aatgcgtgttatgttttgaaaatcg

SEQ ID NO: 6677 - DNA, 85 bp, Artificial Sequence
  Synthetic oligonucleotide
gaaacgccagacttctatcctcattcaaaaatctgggccttgctgagaaccaaggttttgaaatcccatcaggtcaccgcgaggc

SEQ ID NO: 6678 - DNA, 9 bp, Artificial Sequence
  Synthetic oligonucleotide
ctgactggc

SEQ ID NO: 6679 - DNA, 38 bp, Artificial Sequence
  Synthetic oligonucleotide
cttattgttgaataaatgtatctgaatatccaaaaaag

SEQ ID NO: 6680 - DNA, 577 bp, Artificial Sequence
  Synthetic oligonucleotide
ccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaa

SEQ ID NO: 6681 - DNA, 287 bp, Artificial Sequence
  Synthetic oligonucleotide
gtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgg

SEQ ID NO: 6682 - DNA, 220 bp, Artificial Sequence
  Synthetic oligonucleotide
gtaacgtgtacgacgctctctgcacagcgccaggtcccaatcccggtgttccggctcagcacggcccacgcgtttcccagtttccattgcgtttctctttctgaaatcttcttgcccctctcctgggaagctccccgattcttcttggcccttccttcccttccacagtccctctccaccctaagcccagcgggcccgcctcccccctccttcccggcag

SEQ ID NO: 6683 - DNA, 186 bp, Artificial Sequence
  Synthetic oligonucleotide
gtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacag

SEQ ID NO: 6684 - DNA, 500 bp, Artificial Sequence
  Synthetic oligonucleotide
gtacctggggtatcaaacaggtacacgcggcatctggggacgcagccaaactcccccgccactccctggccgcccgtctttccagcgcgcacgattcagtgctgggttcccagaactcattttatcagacatttgcatacgcatatatcccttagccttaacttcacaatttctccaccaacgaaaaatcctgtcactcggcttccaaagaaatagcctaatagactaatagctgtaatcagtcccaaatagctcttttggcacctctagtctagcctccgaaaaagccttcaaaatttcccaagctttttttttttagttggacagtagttagatcaactgcgctggaagtacgctctaggtcacttacgtggaagcagtggagaggcagagccccggctgtctctctggaagggatggggaaagtccgggcgtcatactggggtgggcctggggcccgggaagccgcaaagcggggttgagtgcgccctgtgttgcag

SEQ ID NO: 6685 - DNA, 385 bp, Artificial Sequence
  Synthetic oligonucleotide
gtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgg

SEQ ID NO: 6686 - DNA, 125 bp, Artificial Sequence
  Synthetic oligonucleotide
gcaagttgcagctgctggtggccataaacagtacttccttgactcacatgctgcccgttcagatctgcgagaagtgcagcctgcccccgagctcgaaataaaacagatccttcgtttccttttag

SEQ ID NO: 6687 - DNA, 206 bp, Artificial Sequence
  Synthetic oligonucleotide
tccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaaaaaaaaa

SEQ ID NO: 6688 - DNA, 89 bp, Artificial Sequence
  Synthetic oligonucleotide
gcaagttatttaacacccctgagcttctttcttcatctgcaaaatggaacccctccccttcctttgaattgctgagcccattacgcgag

SEQ ID NO: 6689 - DNA, 172 bp, Artificial Sequence
  Synthetic oligonucleotide
ctcgcatcccaggagcgagcagagccagagcaggatggagaggagacgcatcacctccgctgctcgccgctcctacgtctcctcaggggagatgatggtggggggcctggctcctggccgccgtctgggtcctggcacccgcctctccctggctcgaatgccccctccactc

SEQ ID NO: 6690 - DNA, 215 bp, Artificial Sequence
  Synthetic oligonucleotide
gtgagcgcggccagggcaggacggggacgggcggagcagggacggccaccccaggagatgccaggggagaagggccaggggcgaggacctgggtcgagggcggggcctgaacgttacccccgggctagaggcggggcctggggccgggggccgggcctcgaaacctccccaagtcgggtcggggctccgcgggaccggccggctccatcccacag

SEQ ID NO: 6691 - DNA, 354 bp, Artificial Sequence
  Synthetic oligonucleotide
gtcagtacagcagggcctcgtgggaagggcactggagtcctgccccctcctccagggcctgtaggttgctccagactgggactgaggatcagggcaaagggatccagctctccctgggggccttcgtgacactgcagcgctcctagccagagcctatcataccagggtacttctaggtggggcttgcagctgcccctgtcctgctaggccctggtccctcttcccctccctgcaccccattcgacagcagaactgggtgagagcttgacatctgccctgtctgcagatccctgagcaagcactgcccttctgagtgttttctgtttttgtttttttaactgcttgtcactacag

SEQ ID NO: 6692 - DNA, 120 bp, Artificial Sequence
  Synthetic oligonucleotide
ggggcaaaagcaccaaagacggggaaaatcacaaggtcacaagatatctcaaaagcctcacaatacgagttataccaatacaggctcaccagattgtaaatggaacgccgccggctcgcg

SEQ ID NO: 6693 - DNA, 242 bp, Artificial Sequence
  Synthetic oligonucleotide
gttagctgcctgcctctcagacacggcgctttgcccagcttgacagggagtgagcctcacccaccccatcctcccaatccccctgagttccctcttcccaggcttcccctaaagggcctggactgcgtcattttcccaggaactgcagtgcccagcccaggacgtggtacagagtaactgtacattaaactggcagagcttgttagtggtaaaggtggtgagtccttgggtgcgcagtggag

SEQ ID NO: 6694 - DNA, 1563 bp, Artificial Sequence
  Synthetic oligonucleotide
ctgctctggggcctctgagcaagcagcagcctctgtctcacctcttcctgtcactgggagggccccttgggtctcgctgtgcctggacgccaggctctctgctttattctttcatccctgaggctccatcgctcagctcagtgctgactcagttcagaggattcttccctcaggaccgcagctcttgcagtgaataaagttttatgttccctgctcttaatgttaaatattagtgaatgtgacgtgttatatttttctctctcgggcggggcgggggggggggagagctaaattactttttacttgcattggccctgaaatgattcttagctaaggaacaaaattcctcttcttctggactagaatatttaggaccactagatatgcatgtctcaggacttaattcagcatcagaaaggctaaccaggctgactagtagaggtaatactgccaaatcctagatagtcacaggtcactaaagcacagataaatggcagagagaagtaggaaagaggaaaggggacaggaaagggacctatgtgtattgagcactaatatgtgccacatgtttaacagcctttattttagttaattgtctcctctctcccacctagagaagtaggccccatcatccttattttacagatgaggaaactgaggctgggagaggtcaattaacttgcccagagtcatgtggctggttggtggctaagttgggacttcttgagctctggtctcctgatccttccttccttccttccttcttttcttccttccttccttctttccttccttccttcggcagagcgtccctctgtcactcaggctggaatgcagtagtgcaatcttggctcactgcaacctccacctcccaggttcaagcaattctcgtgcctcagactcccgagtaaggggattacaggtgcgagccaccacacctggctaatctttctttttctttctttctttctttcttccttccttccttccttccttcctttctctttcctgcttgcttgcttgcttgcttgcctgctttcgacggagtcttactctgttgctcaggctggagtgcagtggcacgatcgcagcttactgcaacctccgcctcccaggttcaagtgattctcctctctcagcctcctgagtagctgggactacaggcacctgtcaccatgcctgactaatttttgtatttttagtagagacagggtttcaccatattagtcaggctggtctcaaactcctgacctcaggcgatccacctgcctcggcctcccaaagtgctgggattacaggtgtgagccaccatgcctggcctattttttgtatttttagtagaggtttcactatgttggccaggctggtctcgaactcctggcgtcaggtgatccacctgcctcagcctcccaaaatgatggcattataggtgtgagccaccgcacccctcctggtctcctgatttcaataccgtgctgggttttcagaaagccaggtgccaggccagggcttgcagaggggctgaaatgaagccaggccagaagacagagcagccaggactct

SEQ ID NO: 6695 - DNA, 186 bp, Artificial Sequence
  Synthetic oligonucleotide
ggcagcagcactattgggatttgggggctctccagcccgtttggaagagcctaggctctctctgctcggttgcataggttctcatactcatgatggggaggggggtgcgatggggaagccgggcatgggagaggatggctcatgccctgaaagtccatgagaggcctcctctccccacatctgcag

SEQ ID NO: 6696 - DNA, 136 bp, Artificial Sequence
  Synthetic oligonucleotide
cttgcgttagaatgaggaggaaggagagaaggggaggagggcggggggcacctactacatcgccctccacatccctgattcctgttgttatggaaactgttgccagagatggaggttctctcggagtatctgggaa

SEQ ID NO: 6697 - DNA, 296 bp, Artificial Sequence
  Synthetic oligonucleotide
acaaggtagccctggccagaggcttgttttgtcttttggtttttatgaggtgggatatccctatgctgcctaggctgaccttgaactcctgggctcaagcagtctacccacctcagcctcctgtgtagctgggattatagattggagccaccatgcccagctcagagggttgttctcctagactgaccctgatcagtctaagatgggtggggacgtcctgccacctggggcagtcacctgcccagatcccagaaggacctcctgagcgatgactcaagtgtctcagtccacctgag

SEQ ID NO: 6698 - DNA, 214 bp, Artificial Sequence
  Synthetic oligonucleotide
tgctgctgcctttagtcgctgaggaaaaataaagacaaatgctgcgcccttccccagagtggactctgatctgttcatgagagggcgggactggggccaagatgtagcctttgacaagaccaactcatttcttattactgatcatctctggggcccatgccctcaccaaattccacccgcagccaaagaggacatacaccagctccctccactc

SEQ ID NO: 6699 - DNA, 40 bp, Artificial Sequence
  Synthetic oligonucleotide
ccgacccgggtggatttctccctggctggggcactcaatg

SEQ ID NO: 6700 - DNA, 47 bp, Artificial Sequence
  Synthetic oligonucleotide
ctggcttcaaggagacccgggccagtgagcgggcagagatgatggag

SEQ ID NO: 6701 - DNA, 20 bp, Artificial Sequence
  Synthetic oligonucleotide
ctcaatgaccgctttgccag

SEQ ID NO: 6702 - DNA, 13 bp, Artificial Sequence
  Synthetic oligonucleotide
ctacatcgagaag

SEQ ID NO: 6703 - DNA, 30 bp, Artificial Sequence
  Synthetic oligonucleotide
gttcgcttcctggaacagcaaaacaaggcg

SEQ ID NO: 6704 - DNA, 7 bp, Artificial Sequence
  Synthetic oligonucleotide
ctggctg

SEQ ID NO: 6705 - DNA, 14 bp, Artificial Sequence
  Synthetic oligonucleotide
ctgagctgaaccag

SEQ ID NO: 6706 - DNA, 20 bp, Artificial Sequence
  Synthetic oligonucleotide
ctgcgggccaaggagcccac

SEQ ID NO: 6707 - DNA, 4 bp, Artificial Sequence
  Synthetic oligonucleotide
caag

SEQ ID NO: 6708 - DNA, 24 bp, Artificial Sequence
  Synthetic oligonucleotide
ctggcagacgtctaccaggctgag

SEQ ID NO: 6709 - DNA, 30 bp, Artificial Sequence
  Synthetic oligonucleotide
ctgcgagagctgcggctgcggctcgatcaa

SEQ ID NO: 6710 - DNA, 54 bp, Artificial Sequence
  Synthetic oligonucleotide
ctcaccgccaacagcgcccggctggaggttgagagggacaatctggcacaggac

SEQ ID NO: 6711 - DNA, 20 bp, Artificial Sequence
  Synthetic oligonucleotide
ctggccactgtgaggcagaa

SEQ ID NO: 6712 - DNA, 32 bp, Artificial Sequence
  Synthetic oligonucleotide
gctccaggatgaaaccaacctgaggctggaag

SEQ ID NO: 6713 - DNA, 11 bp, Artificial Sequence
  Synthetic oligonucleotide
ccgagaacaac

SEQ ID NO: 6714 - DNA, 18 bp, Artificial Sequence
  Synthetic oligonucleotide
ctggctgcctatagacag

SEQ ID NO: 6715 - DNA, 33 bp, Artificial Sequence
  Synthetic oligonucleotide
gaagcagatgaagccaccctggcccgtctggat

SEQ ID NO: 6716 - DNA, 12 bp, Artificial Sequence
  Synthetic oligonucleotide
ctggagaggaag

SEQ ID NO: 6717 - DNA, 9 bp, Artificial Sequence
  Synthetic oligonucleotide
attgagtcg

SEQ ID NO: 6718 - DNA, 6 bp, Artificial Sequence
  Synthetic oligonucleotide
ctggag

SEQ ID NO: 6719 - DNA, 36 bp, Artificial Sequence
  Synthetic oligonucleotide
gaggagatccggttcttgaggaagatccacgaggag

SEQ ID NO: 6720 - DNA, 24 bp, Artificial Sequence
  Synthetic oligonucleotide
gaggttcgggaactccaggagcag

SEQ ID NO: 6721 - DNA, 48 bp, Artificial Sequence
  Synthetic oligonucleotide
ctggcccgacagcaggtccatgtggagcttgacgtggccaagccagac

SEQ ID NO: 6722 - DNA, 21 bp, Artificial Sequence
  Synthetic oligonucleotide
ctcaccgcagccctgaaagag

SEQ ID NO: 6723 - DNA, 69 bp, Artificial Sequence
  Synthetic oligonucleotide
atccgcacgcagtatgaggcaatggcgtccagcaacatgcatgaagccgaagagtggtaccgctccaag

SEQ ID NO: 6724 - DNA, 33 bp, Artificial Sequence
  Synthetic oligonucleotide
tttgcagacctgacagacgctgctgcccgcaac

SEQ ID NO: 6725 - DNA, 6 bp, Artificial Sequence
  Synthetic oligonucleotide
gcggag

SEQ ID NO: 6726 - DNA, 75 bp, Artificial Sequence
  Synthetic oligonucleotide
ctgctccgccaggccaagcacgaagccaacgactaccggcgccagttgcagtccttgacctgcgacctggagtct

SEQ ID NO: 6727 - DNA, 12 bp, Artificial Sequence
  Synthetic oligonucleotide
ctgcgcggcacg

SEQ ID NO: 6728 - DNA, 33 bp, Artificial Sequence
  Synthetic oligonucleotide
aacgagtccctggagaggcagatgcgcgagcag

SEQ ID NO: 6729 - DNA, 12 bp, Artificial Sequence
  Synthetic oligonucleotide
gaggagcggcac

SEQ ID NO: 6730 - DNA, 9 bp, Artificial Sequence
  Synthetic oligonucleotide
gtgcgggag

SEQ ID NO: 6731 - DNA, 30 bp, Artificial Sequence
  Synthetic oligonucleotide
gcggccagttatcaggaggcgctggcgcgg

SEQ ID NO: 6732 - DNA, 51 bp, Artificial Sequence
  Synthetic oligonucleotide
ctggaggaagaggggcagagcctcaaggacgagatggcccgccacttgcag

SEQ ID NO: 6733 - DNA, 15 bp, Artificial Sequence
  Synthetic oligonucleotide
gagtaccaggacctg

SEQ ID NO: 6734 - DNA, 48 bp, Artificial Sequence
  Synthetic oligonucleotide
ctcaatgtcaagctggccctggacatcgagatcgccacctacaggaag

SEQ ID NO: 6735 - DNA, 23 bp, Artificial Sequence
  Synthetic oligonucleotide
ctgctagagggcgaggagaaccg

SEQ ID NO: 6736 - DNA, 44 bp, Artificial Sequence
  Synthetic oligonucleotide
gatcaccattcccgtgcagaccttctccaacctgcagattcgag

SEQ ID NO: 6737 - DNA, 33 bp, Artificial Sequence
  Synthetic oligonucleotide
aaaccagcctggacaccaagtctgtgtcagaag

SEQ ID NO: 6738 - DNA, 13 bp, Artificial Sequence
  Synthetic oligonucleotide
gccacctcaagag

SEQ ID NO: 6739 - DNA, 10 bp, Artificial Sequence
  Synthetic oligonucleotide
gaacatcgtg

SEQ ID NO: 6740 - DNA, 15 bp, Artificial Sequence
  Synthetic oligonucleotide
gtgaagaccgtggag

SEQ ID NO: 6741 - DNA, 15 bp, Artificial Sequence
  Synthetic oligonucleotide
atgcgggatggagag

SEQ ID NO: 6742 - DNA, 18 bp, Artificial Sequence
  Synthetic oligonucleotide
gtcattaaggagtccaag

SEQ ID NO: 6743 - DNA, 63 bp, Artificial Sequence
  Synthetic oligonucleotide
caggagcacaaggatgtgatgtgaggcaggacccacctggtggcctctgccccgtctcatgag

SEQ ID NO: 6744 - DNA, 12 bp, Artificial Sequence
  Synthetic oligonucleotide
gggcccgagcag

SEQ ID NO: 6745 - DNA, 60 bp, Artificial Sequence
  Synthetic oligonucleotide
aagcaggatagttgctccgcctctgctggcacatttccccagacctgagctccccaccac

SEQ ID NO: 6746 - DNA, 55 bp, Artificial Sequence
  Synthetic oligonucleotide
cccagctgctcccctccctcctctgtccctaggtcagcttgctgccctaggctcc

SEQ ID NO: 6747 - DNA, 69 bp, Artificial Sequence
  Synthetic oligonucleotide
gtcagtatcaggcctgccagacggcacccacccagcacccagcaactccaactaacaagaaactcaccc

SEQ ID NO: 6748 - DNA, 5 bp, Artificial Sequence
  Synthetic oligonucleotide
ccaag

SEQ ID NO: 6749 - DNA, 7 bp, Artificial Sequence
  Synthetic oligonucleotide
gggcagt

SEQ ID NO: 6750 - DNA, 6 bp, Artificial Sequence
  Synthetic oligonucleotide
ctggag

SEQ ID NO: 6751 - DNA, 15 bp, Artificial Sequence
  Synthetic oligonucleotide
gggcatggccagcag

SEQ ID NO: 6752 - DNA, 26 bp, Artificial Sequence
  Synthetic oligonucleotide
ctgtgcctttgagtttcctcaggctg

SEQ ID NO: 6753 - DNA, 45 bp, Artificial Sequence
  Synthetic oligonucleotide
ctggaggaaaactgagactcagacaggaaagggaaggccccacag

SEQ ID NO: 6754 - DNA, 20 bp, Artificial Sequence
  Synthetic oligonucleotide
ctgccatccagggatgccat

SEQ ID NO: 6755 - DNA, 21 bp, Artificial Sequence
  Synthetic oligonucleotide
ctgtgggcacgctgtgggcag

SEQ ID NO: 6756 - DNA, 7 bp, Artificial Sequence
  Synthetic oligonucleotide
gtgggag

SEQ ID NO: 6757 - DNA, 24 bp, Artificial Sequence
  Synthetic oligonucleotide
cttgattctcagcacttgggggat

SEQ ID NO: 6758 - DNA, 36 bp, Artificial Sequence
  Synthetic oligonucleotide
ctgttgtgtacgtggagagggatgaggtgctgggag

SEQ ID NO: 6759 - DNA, 17 bp, Artificial Sequence
  Synthetic oligonucleotide
ggatagaggggggctgc

SEQ ID NO: 6760 - DNA, 11 bp, Artificial Sequence
  Synthetic oligonucleotide
ctggcccccag

SEQ ID NO: 6761 - DNA, 33 bp, Artificial Sequence
  Synthetic oligonucleotide
ctgtgggtacagagaggtcaagcccaggaggac

SEQ ID NO: 6762 - DNA, 4 bp, Artificial Sequence
  Synthetic oligonucleotide
tgcc

SEQ ID NO: 6763 - DNA, 21 bp, Artificial Sequence
  Synthetic oligonucleotide
ccgtgcagactggaggggacg

SEQ ID NO: 6764 - DNA, 9 bp, Artificial Sequence
  Synthetic oligonucleotide
ctggtagag

SEQ ID NO: 6765 - DNA, 60 bp, Artificial Sequence
  Synthetic oligonucleotide
atggaggaggaggcaattgggatggcgctaggcatacaagtaggggttgtgggtgaccag

SEQ ID NO: 6766 - DNA, 57 bp, Artificial Sequence
  Synthetic oligonucleotide
ttgcacttggcctctggattgtgggaattaaggaagtgactcatcctcttgaagatg

SEQ ID NO: 6767 - DNA, 91 bp, Artificial Sequence
  Synthetic oligonucleotide
ctgaaacaggagagaaaggggatgtatccatgggggcagggcatgactttgtcccatttctaaaggcctcttccttgctgtgtcataccag

SEQ ID NO: 6768 - DNA, 4 bp, Artificial Sequence
  Synthetic oligonucleotide
gccg

SEQ ID NO: 6769 - DNA, 29 bp, Artificial Sequence
  Synthetic oligonucleotide
ccccagcctctgagcccctgggactgctg

SEQ ID NO: 6770 - DNA, 14 bp, Artificial Sequence
  Synthetic oligonucleotide
cttcttaaccccag

SEQ ID NO: 6771 - DNA, 32 bp, Artificial Sequence
  Synthetic oligonucleotide
taagccactgccacacgtctgaccctctccac

SEQ ID NO: 6772 - DNA, 11 bp, Artificial Sequence
  Synthetic oligonucleotide
cccatagtgac

SEQ ID NO: 6773 - DNA, 23 bp, Artificial Sequence
  Synthetic oligonucleotide
cggctgcttttccctaagccaag

SEQ ID NO: 6774 - DNA, 117 bp, Artificial Sequence
  Synthetic oligonucleotide
ggcctcttgcggtcccttcttactcacacacaaaatgtacccagtattctaggtagtgccctattttacaattgtaaaactgaggcacgagcaaagtgaagacactggctcatattc

SEQ ID NO: 6775 - DNA, 51 bp, Artificial Sequence
  Synthetic oligonucleotide
ctgcagcctggaggccgggtgctcagggctgacacgtccaccccagtgcac

SEQ ID NO: 6776 - DNA, 70 bp, Artificial Sequence
  Synthetic oligonucleotide
ccactctgctttgactgagcagactggtgagcagactggtgggatctgtgcccagagatgggactgggag

SEQ ID NO: 6777 - DNA, 33 bp, Artificial Sequence
  Synthetic oligonucleotide
ggcccacttcagggttctcctctcccctctaag

SEQ ID NO: 6778 - DNA, 45 bp, Artificial Sequence
  Synthetic oligonucleotide
gccgaagaagggtccttccctctccccaagacttggtgtcctttc

SEQ ID NO: 6779 - DNA, 20 bp, Artificial Sequence
  Synthetic oligonucleotide
cctccactccttcctgccac

SEQ ID NO: 6780 - DNA, 34 bp, Artificial Sequence
  Synthetic oligonucleotide
ctgctgctgctgctgctgctaatcttcagggcac

SEQ ID NO: 6781 - DNA, 815 bp, Artificial Sequence
  Synthetic oligonucleotide
ggaacagcctgacgaagaggaactttgggtaccagccagctgacgacagcaagatctggtccggtgcgcgcgggaggaagctgggaagggacgtcgcgcccagatcccgaggtccttgaggaccaggccctctctgcaaggaatcggggaggaaaatctcaaactattaatagaagagcggcaaaaaggaattcgtgcgcacccctctctgttggaaggaccttccctgccagagaccaaggctggcaggacaggtatacttccctcagggggaaacagccgacaaaggtggtcaaggtcgcccgcgcaggctccggagctgcacgtcctggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaag

SEQ ID NO: 6782 - DNA, 174 bp, Artificial Sequence
  Synthetic oligonucleotide
gtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccg

SEQ ID NO: 6783 - DNA, 182 bp, Artificial Sequence
  Synthetic oligonucleotide
catatcgcacggatgactgccatccctgggttttgccagtagtgaagaaagtggagcagaagattgctaatgacaatagcctaaatcacgagtatctgccaatcctgggcctggctgagttccggagctgtgcttctcgtcttgcccttggggatgacagcccagcactcaaggagaagcgg

SEQ ID NO: 6784 - DNA, 124 bp, Artificial Sequence
  Synthetic oligonucleotide
gtaggaggtgtgcaatctttggggggaacaggtgcacttcgaattggagctgatttcttagcgcgttggtacaatggaacaaacaacaagaacacacctgtctatgtgtcctcaccaacctggg

SEQ ID NO: 6785 - DNA, 1621 bp, Artificial Sequence
  Synthetic oligonucleotide
agatgagatcattttgtctgtactgttttgtgcaacacaatttgtttttcattttcacttctttatatacatgtcattgaatattttgcagcatcatttttcatagctatattatatttctttcatggatatgtcatattagggatggggtaaatcatctgatgaatatttaggtttacttcagattgcttgatctgatgaaaaattatgtaacaaaatttccttttattatttctttggcgtaactttctaggtgggaattcctagctgaaagtgtgtatattcttccttaacgagtttgtagaatacttattaaggaactgctgtgtattggacactgtgggaatacagtattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcag

SEQ ID NO: 6786 - DNA, 120 bp, Artificial Sequence
  Synthetic oligonucleotide
cctatcagggcttcgcatctggaaacctggagagagatgcctgggccattcgctattttgtgtctgaaggcttcgagttcttctgtgcccagtccttctccaagaacttcgggctctaca

SEQ ID NO: 6787 - DNA, 143 bp, Artificial Sequence
  Synthetic oligonucleotide
gacaggtaatgtgaagacaatggctgaccggattctgaccatgagatctgaactcagggcacgactagaagccctcaaaacccctgggacctggaaccacatcactgatcaaattggcatgttcagcttcactgggttgaacc

SEQ ID NO: 6788 - DNA, 508 bp, Artificial Sequence
  Synthetic oligonucleotide
gtaagtggcccccaccacctccagcccatgcgtgcatgtagacacacaacattcctttcagtcgctcgccttgagctgagctcactttcacagcctttgcctaattgggcagccattgctttggaccaggacaagttaggttttcttagggtgtcccaccatctcataaactctctgggtctcagaagagtattgtggtctgccctgctgacccacagccaagatatttccgtgtttgtgggctgggaagtggctcagagccagctgggaggtaacaggattggtagctgggagccttaatttatgaaaggttcttataaatgctcaggtacattttgggtttgccttaatcctgaatataatgattattcagggaactgatttcttgacaggtctttcttatttctaggtattatcctcaaaaagagattacaaagttatctctgcatttcataaacaagaacctagattgggctgggcacagtggctcacacctgtaatcccaaag

SEQ ID NO: 6789 - DNA, 561 bp, Artificial Sequence
  Synthetic oligonucleotide
tacttggattacaggcatgagccactgtgcctggccagcatgcaaatttattaacttgcacaggtgtcttacaaaatagaactcaaataaatggccagatgattgatgcttttataccatcttggggttatagaaagaatgggagcttggagcttgccagaacagattatggcaggcagagaagagaaggcctggttagcaaaggtggtcttgttatattatgtagataagacaggtagcagccctcggagaaaatagcggtaaaggtctatttcttttagacctttaaaggcatcacactctcagttaatctcccctagatctggacaagggagggcctcagagaaagcctagctgcagccatgcagattttctctacagatacagatctctcccacaaaagacagctttgcagggctacttctgtatgtaggccctctcaacagccatctcaaaatatgtcaaagtatattttggggtgaactattttggtttccttcaaggagcactgagtccagggtccagatttttcacttccttagagaggcactgtagcatcac

SEQ ID NO: 6790 - DNA, 698 bp, Artificial Sequence
  Synthetic oligonucleotide
caaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagaaaaggagt

SEQ ID NO: 6791 - DNA, 31 bp, Artificial Sequence
  Synthetic oligonucleotide
gacccccgcaaggtcaacctgggagtgggag

SEQ ID NO: 6792 - DNA, 113 bp, Artificial Sequence
  Synthetic oligonucleotide
agaatcacaatgctgtgttttccgctgctggttttaaagacattcggtcctatcgctactgggatgcagagaagagaggattggacctccagggcttcctgaatgatctggag

SEQ ID NO: 6793 - DNA, 105 bp, Artificial Sequence
  Synthetic oligonucleotide
aatgctcctgagttctccattgttgtcctccacgcctgtgcacacaacccaactgggattgacccaactccggagcagtggaagcagattgcttctgtcatgaag

SEQ ID NO: 6794 - DNA, 31 bp, Artificial Sequence
  Synthetic oligonucleotide
caccggtttctgttccccttctttgactcag

SEQ ID NO: 6795 - DNA, 89 bp, Artificial Sequence
  Synthetic oligonucleotide
gtgagtgctctcctgaggagttacagccccacctcctcgcatcactccctgcttcagcagccacagctgattctggtccctctctttag

SEQ ID NO: 6796 - DNA, 79 bp, Artificial Sequence
  Synthetic oligonucleotide
atgagagagtcgggaatctgactgtggttggaaaagaacctgagagcatcctgcaagtcctttcccagatggagaagat

SEQ ID NO: 6797 - DNA, 87 bp, Artificial Sequence
  Synthetic oligonucleotide
cgtgcggattacttggtccaatccccccgcccagggagcacgaattgtggccagcaccctctctaaccctgagctctttgaggaatg

SEQ ID NO: 6798 - DNA, 39 bp, Artificial Sequence
  Synthetic oligonucleotide
gtaaggggctcccagtctggtgggccggggggtggggag

SEQ ID NO: 6799 - DNA, 32 bp, Artificial Sequence
  Synthetic oligonucleotide
ccaagcaggttgagtatctggtcaatgaaaag

SEQ ID NO: 6800 - DNA, 50 bp, Artificial Sequence
  Synthetic oligonucleotide
cacatctacctgctgccaagtggtcgaatcaacgtgagtggcttaaccac

SEQ ID NO: 6801 - DNA, 41 bp, Artificial Sequence
  Synthetic oligonucleotide
caaaaatctagattacgtggccacctccatccatgaagcag

SEQ ID NO: 6802 - DNA, 4 bp, Artificial Sequence
  Synthetic oligonucleotide
tcac

SEQ ID NO: 6803 - DNA, 202 bp, Artificial Sequence
  Synthetic oligonucleotide
gctctccaggattgggagattttgtgccatggggctgctcccaggctttccttccaggttcaggcaggtactcagcagtgctaggttctgctgaggcgccaggatccagaatggggcagtgaggcaggtgagagcagggggatcaaggggcagaaggaagtgaggaaggaggtgaaaggactcctggatctctgctgagaag

SEQ ID NO: 6804 - DNA, 302 bp, Artificial Sequence
  Synthetic oligonucleotide
ggcgaggccggcgcggcccccgctaattacataagcgggacgtcaataattcgcgggaaaacgcgaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcg

SEQ ID NO: 6805 - DNA, 553 bp, Artificial Sequence
  Synthetic oligonucleotide
cgcccggccagggtggaggcgggtgcggcgacccggccggctcctagaggcgcagcgggagaggaagtgtcagtttgtgaacctgcagcggccccggcctggcccctggccgggcgggcggggacctcgcagcgccgggcgagccaggtggcagggagaggacagggattcagaccgcatcccctgcccgggagcctgtgcgctctgcgctggagaaaaaggagatgggagtgggggtggagaaggtcgtggccacgccaccatctggggagccgagacccctgcagtgcctggctcgccccagggccccgcacatacttagcttcacacactccctggcacaatgccgtagacatcatcctgcccagtctcacaggagtacacacacgcaccacacagaaacaggcactggactctctccctgtgaacagatagtcacaacaccaggtgcccagcgccatggccacaaggaggagacccgagtaggcccgcggggaaagagagaggctgtgtgtggctgtagtggagagcatgtggagggacttggagccag

SEQ ID NO: 6806 - DNA, 381 bp, Artificial Sequence
  Synthetic oligonucleotide
tccatccagagcacatggactgtgtttgcttaaggaataaaacctcagcctcctgagacagggagtggttcaggcccgctgggtaggggactttgttctgtgtgggttgagagatccattctctttaaaaggtagtgtggtatgggccatggctctgcctttggcccatcagcctcttctccttgccacacctgtttccctatctgtaagatgtgaataataataatgtctccctcataggatggtcacgaggaatcagtgagataataaccaagtctggcttatagcacagggtacagaaatggtggtttccttccttcccctgatgggctttctgaagcagggaagcaagaagcaaaaaccctgttctttctctcccag

SEQ ID NO: 6807 - DNA, 201 bp, Artificial Sequence
  Synthetic oligonucleotide
tgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagg

SEQ ID NO: 6808 - DNA, 127 bp, Artificial Sequence
  Synthetic oligonucleotide
caccttcctgggagcatgttcaagaataggaggcaacgttcctgcctggccatatattcaacaaacgtcttggaacacctgttacatgccacactctatgaggtcctggggatacagagatgaagag

SEQ ID NO: 6809 - DNA, 351 bp, Artificial Sequence
  Synthetic oligonucleotide
taaagttttaagaaaataacaaccatttaacaaaacaagttaaataaggcgggagaggcagcatgatgtgtcaaaagaacaaagggtttgatgtcaaacagccatgggtttaatccccccctcacctacttactagctaagcaagggacttaacctttcagagcctcaatttccccatctttcgaatggtaatgatgataggcatctcagagtggttggggagattcagtgaggtggcatgtggggcccagcgctaggcctagcagacattagaggctgggcatctggaatgtgagtataaaacttccattcctgtgagctggacccgaccctcgaggccctctctttcag

SEQ ID NO: 6810 - DNA, 497 bp, Artificial Sequence
  Synthetic oligonucleotide
gtgagtggagcgagcagggccctgagaaggccccgacctataggtccccacgcactggcccctgacgggtactgctgcagcctgttggggcctcagctggcttcctgtttctcttggcactgcagggtgaaagggggccagttgctgtaagtgagggcttgggaagagatcctggggaaagctgggagggtatgatggtgtatgtaatttggggcccagctagatggagaggatgggtgggaaagatggggctcaggcactgaagtcagaccttcctgtgtcccccccaaccccacaactggccaatgctgtcatttagttcccagcctggacactgacttggccatcttggtgggcaccagcagccaggctcccggcagctggcaggcagagctcctaggacttccctcagccctcccagccctgcctcctttgggccaactggccttgggccacgatgtccttgtgggcgctcaccgccccctcctctgccgtag

SEQ ID NO: 6811 - DNA, 272 bp, Artificial Sequence
  Synthetic oligonucleotide
gtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaatccatgtaaataca

SEQ ID NO: 6812 - DNA, 145 bp, Artificial Sequence
  Synthetic oligonucleotide
gcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggaga

SEQ ID NO: 6813 - DNA, 156 bp, Artificial Sequence
  Synthetic oligonucleotide
gtgagagggtggggcttagtccaaccaccgctgctcctcccagcttctcccctccctcctccctcctggaacaattccatttccagctactgggtcccaaccctgcccctgtctctcagcctggacccagaaagctgtgaccctggctgagcaggc

SEQ ID NO: 6814 - DNA, 162 bp, Artificial Sequence
  Synthetic oligonucleotide
gttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctgg

SEQ ID NO: 6815 - DNA, 547 bp, Artificial Sequence
  Synthetic oligonucleotide
gtatcagtgagggacctagcacagaggtctgctctggagacagggagggaaccaagcagaaagccaagccctcagttaaaaggatccctgctgtgcaggtctgtctgaaggggctttttgcagtagagctttcagcataacatccctgttcccagagcaccacagccctcccctcttctccagccctccccaccttgccccatggttatccacactcaccatgctgtttgatgcttgctcatctttgctcgtattgctccctctgcctgagataccctttgccttgccctagcccatctgaaaactcaggaccctgcttcttccaggaaggctttactaaccctccccaggctgtgctggacgccctcctttgtagttccatagcaccccatgcttaagtatgtccaagggaggaactgcatcttccatcattttattttccaaattattaaaggtcatttagtattttcctgaggacacagaggagggctttagagtcagacctgaactccagaccctgcttatcagtactagctatgtagtttta

SEQ ID NO: 6816 - DNA, 194 bp, Artificial Sequence
  Synthetic oligonucleotide
gaggtttttttgacttcttggactttgaagggtggctgggtaggaaacagacaggtgtggtggtgggaagctcagctgtgggaagacgggcctccactgggatgaaggatgcatgttaggggaacctgcgggccaggttggcaggaacttgctgggccgggccaccagcaggctcacggtcttgcccctctcag

SEQ ID NO: 6817 - DNA, 570 bp, Artificial Sequence
  Synthetic oligonucleotide
atggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtct

SEQ ID NO: 6818 - DNA, 1163 bp, Artificial Sequence
  Synthetic oligonucleotide
ctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgccagtgggggtttgaaagagaatttttggaaccaacattcaaattctgcctcatctggagggaaaccaaaattgggagggggaagaggacccctgatgttttgctgcttccagag

SEQ ID NO: 6819 - DNA, 178 bp, Artificial Sequence
  Synthetic oligonucleotide
atattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcag

SEQ ID NO: 6820 - DNA, 162 bp, Artificial Sequence
  Synthetic oligonucleotide
cttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggag

SEQ ID NO: 6821 - DNA, 204 bp, Artificial Sequence
  Synthetic oligonucleotide
ctagcccaggggtgctgtgggaactgggatccaatttgtagcttcctgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtc

SEQ ID NO: 6822 - DNA, 1425 bp, Artificial Sequence
  Synthetic oligonucleotide
tgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagttataattaatgtgtctgatttatgatttaaaacctccctttgaacaatcacttgtcttccctatagtgaattagctgctgggtggcagaaggaattggctctggcttttgcacttggtttactggaggctgaggaggaatggcaggaccctgtcctctggccaccttgccactcctaccactgccagcaacattctcacccttactgccagagagaatatggaatcttttgtgagtacccgacctttgggggcaaaaaacattagttgagtgccactgagaggtaaaagatggaaaatgaacttagaaattgacactattataatacttagatccgggcatcgtaaaactttatcagtacatcatcacacaattctagaaatatgaaatgagttctagacctgactctgctagttctaacctgtgccactttagtcagattcctttccttcagttttatcacccttcaaatggcagtgataatcccagcacatctgctccccatgtgttgggagagactttgctgtgtgtgactgattattacttcaaaataaacctctaaatttagggcagtttggagaggaaaaaaacaggagatgtaaaggggtaggaaaaaggtcatctatagagaggtaaaggccatggattccactgaattctacagtttgaggggtaaagtgtaacctgtaatcccgaatgaaggactcagtggtgttaatatctgcccttaaacgtcttcattcactatggctcccacttctttctaccactccatcagcttcaaccttttatctgtcctcagaataaaaccacaatgggacttgggggtggtggtggttattctctgggctataattaatggaatggaatgaaaagtggcaccaggtgtcaaaagacctgggttctagtgcaaggtctgcaataagcagctatatggaccctcctaagatcagtgggcctcccaggctagagagtgcctgcttttctgtagtctagtgtttccaaattcacaacaaacatttaccttcggaaattagggacaaagaagtagaattctcagaaatcccccaaattataagttattcttcaaatacttcattctttatactgttttcctcattattataggtatctggaaaaactttgtttgctaagtagacatattaagcttatttttacttacaaagaactgtagcgtacagagaatatttaaaagacaggaagatgccagggaacatatattggatagtgt

SEQ ID NO: 6823 - DNA, 82 bp, Artificial Sequence
  Synthetic oligonucleotide
gtcagcagctctaagcaaagctgcctcgtgactttcgaagataattccaaatactgggtcctatggaaggacatacagcatg

SEQ ID NO: 6824 - DNA, 99 bp, Artificial Sequence
  Synthetic oligonucleotide
cagcagctcttagcaaaggtggctctgctggaatttcgcaggagatattatcccatattaggtgtgcttcctgaatgaggagaaggacatacaggcatg

SEQ ID NO: 6825 - DNA, 85 bp, Artificial Sequence
  Synthetic oligonucleotide
ccggtgttccaggagaggagcccaagtgcaacatctgcctagggaagacatcagggccgctgaatgagatcctcatctgcgggaa

SEQ ID NO: 6826 - DNA, 11 bp, Artificial Sequence
  Synthetic oligonucleotide
gtgtggcctgg

SEQ ID NO: 6827 - DNA, 14 bp, Artificial Sequence
  Synthetic oligonucleotide
gttaccaccagcag

SEQ ID NO: 6828 - DNA, 87 bp, Artificial Sequence
  Synthetic oligonucleotide
tgccacatccccatagcgggcagtgctgaccagcccctgctcacaccttggttctgccgacgctgcatcttcgcactggctgtgcgg

SEQ ID NO: 6829 - DNA, 4 bp, Artificial Sequence
  Synthetic oligonucleotide
aaag

SEQ ID NO: 6830 - DNA, 96 bp, Artificial Sequence
  Synthetic oligonucleotide
atggtacctgcggatgctgcaatgttaccggtgcaggcagtggttccacgaggcctgcacccagtgcctcaatgagcccatgatgtttggagaccg

SEQ ID NO: 6831 - DNA, 69 bp, Artificial Sequence
  Synthetic oligonucleotide
gttttacctgttcttctgctccgtgtgtaaccagggcccagagtacatcgagaggctgcccctgcgatg

SEQ ID NO: 6832 - DNA, 43 bp, Artificial Sequence
  Synthetic oligonucleotide
ggtggatgtggttcacctggccctctataatctgggggtacag

SEQ ID NO: 6833 - DNA, 78 bp, Artificial Sequence
  Synthetic oligonucleotide
agcaagaagaagtactttgactttgaggagattctggcctttgtcaaccaccactgggagctcctgcagcttggcaag

SEQ ID NO: 6834 - DNA, 68 bp, Artificial Sequence
  Synthetic oligonucleotide
ctcaccagcaccccagtgacagatcgaggaccacatctcctcaacgctctgaacagttataaaagccg

SEQ ID NO: 6835 - DNA, 88 bp, Artificial Sequence
  Synthetic oligonucleotide
tttgttgcctcacgaattccagcagcagaaaaggcgagtttatagaagaaaaagatcaaagtttttgctggaagatgctattcccagt

SEQ ID NO: 6836 - DNA, 86 bp, Artificial Sequence
  Synthetic oligonucleotide
agtgacttcacctcagcctggagcaccaaccaccacctggctagcatatttgacttcacgctggatgaaattcaaagtttaaaaag

SEQ ID NO: 6837 - DNA, 96 bp, Artificial Sequence
  Synthetic oligonucleotide
tgccagctcaggccagaccttcttctcagatgtcgactccaccgacgctgccagcacctctggctctgcctccaccagcctctcctatgactccag

SEQ ID NO: 6838 - DNA, 70 bp, Artificial Sequence
  Synthetic oligonucleotide
caggcctgcaggagctgtttttccattgctaggcctgacccctctctacctgtgagcgttcagggggtcc

SEQ ID NO: 6839 - DNA, 50 bp, Artificial Sequence
  Synthetic oligonucleotide
ctgagatagtttagatgcccccccatcttagacctcagctcccacagtgc

SEQ ID NO: 6840 - DNA, 15 bp, Artificial Sequence
  Synthetic oligonucleotide
ctgagaagccaaccc

SEQ ID NO: 6841 - DNA, 237 bp, Artificial Sequence
  Synthetic oligonucleotide
gtctcctggctcagggacctgagagacaggggttaaaaggacgttccagaagcatctggggacagaaccagcctcttccagggaggcctgggagctgggggggtgtgtctggcagtccctgcagccctgggctctgcggcccctgcgtcctccgcttggctctgccactgcatctgagtgtcttctctcctcacggctccccgcatttctaactctttctgcctcctcgtctcaaag

SEQ ID NO: 6842 - DNA, 196 bp, Artificial Sequence
  Synthetic oligonucleotide
caggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatg

SEQ ID NO: 6843 - DNA, 137 bp, Artificial Sequence
  Synthetic oligonucleotide
gtgatttccctgacaccatccagtgtgcatacatccacctggtgtcccgtgaggagtgtgagcatgcctaccctggccagatcacccagaacatgttgtgtgctggggatgagaagtacgggaaggattcctgccag

SEQ ID NO: 6844 - DNA, 417 bp, Artificial Sequence
  Synthetic oligonucleotide
ggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcat

SEQ ID NO: 6845 - DNA, 275 bp, Artificial Sequence
  Synthetic oligonucleotide
ctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgagtgggg

SEQ ID NO: 6846 - DNA, 52 bp, Artificial Sequence
  Synthetic oligonucleotide
ctgttccttcccccgactcaagaatccccggaggcccggaggcctgcagcag

SEQ ID NO: 6847 - DNA, 48 bp, Artificial Sequence
  Synthetic oligonucleotide
gagcggccatgaagaagctgatggtggtgctgagtctgattgctgcag

SEQ ID NO: 6848 - DNA, 52 bp, Artificial Sequence
  Synthetic oligonucleotide
gaatcttcaggtcttcctggggaagcataaccttcggcaaagggagagttcc

SEQ ID NO: 6849 - DNA, 1148 bp, Artificial Sequence
  Synthetic oligonucleotide
ttttgagacggagtctcactctggcgccgtggctggagtgcggtggcaccatctcggctcattgcaacctacacctcccgggttcaagcgattctcctgcctcagcctcccgagtagctaggactacaggcgtgccaccatccccggctaatttttgtgtttttagtagagacggggtttcgccatgttggccaggctggtctcgagctcctcacctcaggtgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggaggcaagaaactgcagaaagtaaagggaaagggagcccagtgccgggcggcgctgagcagctcccccagcggccaccgtcgccaacatccctgcgtaggggtttgtatcgcagcgcgcttccagacatcaacggctgcgcggcccacgcgcgcgcatgcgtcctgaccaggggaaccttttcttggggacccggaggcgagcgctggaaggcgggatagtggcgacccacacgcagcagcttccggcggcgcgtagtcttgattggtggaacctgggagagggggcggggcaccggggaattcgaatgggagaggcgggcccaaggagggagtggaatggccgcgggcggctcgacgcagcagaggcgacgcgagatggcggcagcttcagcggcggcgatctcag

SEQ ID NO: 6850 - DNA, 227 bp, Artificial Sequence
  Synthetic oligonucleotide
ccgcctggctcctgccttctccctgtttcctgctctccccttgggtcagtagactcgggtctccggtccaggctcttggcttgaaccccgcgcactttttctttgtgagcttcggtttcttcgtctgtgaaacgggggtcatggcctcatccctggagatcacctgaataagcaagagaagagtggcggacgctctagccacgaggacgagaagaagggagccggag

SEQ ID NO: 6851 - DNA, 196 bp, Artificial Sequence
  Synthetic oligonucleotide
gagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaatacca

SEQ ID NO: 6852 - DNA, 149 bp, Artificial Sequence
  Synthetic oligonucleotide
ggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccag

SEQ ID NO: 6853 - DNA, 214 bp, Artificial Sequence
  Synthetic oligonucleotide
ctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacag

SEQ ID NO: 6854 - DNA, 123 bp, Artificial Sequence
  Synthetic oligonucleotide
aagcccatcagtagctttgctgattttgagcggcacttcctgccagccagtcgaaatcggactgtaggagccacccggctcaaccagcgctcctcccgcagtcatgctgtgctcctggtcaag

SEQ ID NO: 6855 - DNA, 190 bp, Artificial Sequence
  Synthetic oligonucleotide
gtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctc

SEQ ID NO: 6856 - DNA, 133 bp, Artificial Sequence
  Synthetic oligonucleotide
gtcaggcccacctgtctcagggaagaaggggctgcagaaggaggttctcaggcctgctgtggggtggggaatagcagttgaggcataggaaggctgggcttctgacccacccactgcctggtctcaccctcag

SEQ ID NO: 6857 - DNA, 604 bp, Artificial Sequence
  Synthetic oligonucleotide
gccggatgcggtggctcactcctgtaaccccagcactttgggagactgaggttgggtggatcacctgaggtcaggagttcgagaccagcctggccaacatggtgaaacctcatctctactaaaaaatacaaaaagtagccggatgtggtggcatgtgcctgtaatcccagctacttgggaggctgaggcaggagaatcccttgaacccaggaagcagaggttgcagtgagctgagattgtggccattgcactccagcctgggcgacacagcaagactccgtctcaaagtaaataagtgaattcaaccctggctaggcacggtggctcacgcctgtaatcccagcactttgggaggccaagacgggtggatcacctgaggtcaggagttcaagaccagcctggccaacatggtgaaaccccatctctactaaaaatacaaaaattagccaggcatggtagtgggcacctgtaatcccagctactcaggaggctgaggcaggaagaattgcttgaatctgggaggtgaaagttgcagtgagccaagatcatgccactgcactccagcctaggtgacagagcaagactgcatctcaataaataaata

SEQ ID NO: 6858 - DNA, 1420 bp, Artificial Sequence
  Synthetic oligonucleotide
tagcccaaataaagcctgtgaactactaaacagaggtgacctgaggtggccaagggttagtgcccactctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatacgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcctggctgtcaccttattatggtctcttgatttcctcagtagacagtgcctccagggcagggcagtgtcttaggtctctcatacctggcactcaagtgttcgcctgatttcctggcatccccgagcagtcacttcacctgatgaagacactgcacccagagaaactggatgcctagcaagttaacattaggttctggagctacaggatataccaagttaaggtgtggtgaggggagtcctgctgctgtaggtggtgatgagggaggaggtaggtggggagcaacttctttttctg

SEQ ID NO: 6859 - DNA, 169 bp, Artificial Sequence
  Synthetic oligonucleotide
ccccctacagaagctaagcagcatggacccggccatgctggagcgcctcctcagcttggaccgtctgcttgcctcccaggggagccagggggcccctctgttgagtaccccaaagcgagagcggatggtgctaatgaagacagtagaagagaaggacctagagattgag

SEQ ID NO: 6860 - DNA, 461 bp, Artificial Sequence
  Synthetic oligonucleotide
gtacgtgttttagggatgtgggagctggattcctattggccttgagaagcaatccttggatcttcagacagggaaggacactcaggctggactagagtccagttttctcccaataccggaagttctccagcttctgcttgaatgtccttaacatggctgaactttgacagacaattgagaccagatgtgagggtgagaagaaaaagttcaaagtaaaagcaacaaatgttaaacattacatttcctaaagcccagctcaattaattgaggactgtgcttgaaaagcctttcccttcaatatttgcagaggcttgttccacctctgggtagccccctaatcacagaaagcccttaattatgttaggctccacctgtctcctggtaacctcccactggtcctagccctgccctctgggggctcagagccttgcatactcaccctggtaacccactcccttcag

SEQ ID NO: 6861 - DNA, 160 bp, Artificial Sequence
  Synthetic oligonucleotide
aggcttaagacgaagcaaaaagaactggaggccaagatgttggcccagaaggctgaggaaaaggagaaccattgtcccacaatgctccggcccctttcacatcgcacagtcacaggggcaaagcccctgaaaaaggctgtggtgatgcccctacagctaa

SEQ ID NO: 6862 - DNA, 468 bp, Artificial Sequence
  Synthetic oligonucleotide
gtaagggggagtaggctctagggggaggagcgttggccttggggttaaacgaactggatgatggccgccagctactaacagacctcaacttgcttacccctggaatgtggtgatggatggttccttgcagggcatttagggtggaaggcagtgatgtggatgtacctcgcagagcggatgttccactgtgtagcctggcttctaccctctacaagcttaagagggaaaacttagggaactatgacctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacag

SEQ ID NO: 6863 - DNA, 136 bp, Artificial Sequence
  Synthetic oligonucleotide
gggattttggacacacttgacaagagaggaagaggctggagcgcaggaggtagctggtgctgggctcctagtcttggcagaggagcccaaagcacttggctgccctgcgtgtcactcatctccctttgcctcccag

SEQ ID NO: 6864 - DNA, 730 bp, Artificial Sequence
  Synthetic oligonucleotide
gcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccgcctcggggtgggccgcgagcaaggcaggcgactccactgggcgccatcttcggggaacgactcagcgcaggattgtaaatacaccgctggggtggggcggggaggacggtggcctgcaggacgcaaaaagcggaagccgaagcatgaggcctgcgaccgttaggcgggcgcgcgctcagggattagccccgccccgtccgtgcccccggcgcgcgcgctcccccattctcccgctcggcaacgacggcggccttgtgcgcgtgcgcgcgaaataacggccgctggcggagggagggggagtggaatcgttggcggggggaagaggagagaagccgccctgtctcccgcgcgcccaccacctgcgccatcgtcagccaatcagcagccgtctcaggggtctcgcgctcggggcgactcgggctgctgggtggctcccccgtccctcctcccgccagagtccctctcgcgcctgcccctcccgctggccacgcgcgcgctcgcgctagcgctcgcgcccgctccagcctcttgtgtgtcctcgcgccccccgcccgccctc

SEQ ID NO: 6865 - DNA, 94 bp, Artificial Sequence
  Synthetic oligonucleotide
gtttgatgccttctatggggagaggagtactcagcaggacatctatgcaggttcagtgcagcccatcctaaggcacttgctggaagggcagaat

SEQ ID NO: 6866 - DNA, 34 bp, Artificial Sequence
  Synthetic oligonucleotide
gccagtgtgcttgcctatggacccacaggagctg

SEQ ID NO: 6867 - DNA, 6 bp, Artificial Sequence
  Synthetic oligonucleotide
gagaag

SEQ ID NO: 6868 - DNA, 13 bp, Artificial Sequence
  Synthetic oligonucleotide
gtgaggccccgtg

SEQ ID NO: 6869 - DNA, 87 bp, Artificial Sequence
  Synthetic oligonucleotide
gtattagacctcctggaccctgcttcgggagacctggtaatccgagaagactgccgggggaatatcctgattccgggtctctcccag

SEQ ID NO: 6870 - DNA, 41 bp, Artificial Sequence
  Synthetic oligonucleotide
gtgtaccttatcgggacagcaagctcactcgcctattgcag

SEQ ID NO: 6871 - DNA, 24 bp, Artificial Sequence
  Synthetic oligonucleotide
gactctctgggtggctcagcccac

SEQ ID NO: 6872 - DNA, 84 bp, Artificial Sequence
  Synthetic oligonucleotide
agtatccttattgccaacattgcccctgagagacgcttctacctagacacagtctccgcactcaactttgctgccaggtccaag

SEQ ID NO: 6873 - DNA, 33 bp, Artificial Sequence
  Synthetic oligonucleotide
gaggtgatcaatcggccttttaccaatgagagc

SEQ ID NO: 6874 - DNA, 13 bp, Artificial Sequence
  Synthetic oligonucleotide
ctgcagcctcatg

SEQ ID NO: 6875 - DNA, 85 bp, Artificial Sequence
  Synthetic oligonucleotide
ccttgggacctgttaagctgtctcagaaagaattgcttggtccaccagaggcaaagagagcccgaggccctgaggaagaggagat

SEQ ID NO: 6876 - DNA, 51 bp, Artificial Sequence
  Synthetic oligonucleotide
tgggagccctgagcccatggcagctccagcctctgcctcccagaaactcag

SEQ ID NO: 6877 - DNA, 5 bp, Artificial Sequence
  Synthetic oligonucleotide
ctcag

SEQ ID NO: 6878 - DNA, 50 bp, Artificial Sequence
  Synthetic oligonucleotide
gctgccctggagttgggtctggatcacatctccctgatcctttccaacag

SEQ ID NO: 6879 - DNA, 68 bp, Artificial Sequence
  Synthetic oligonucleotide
ttcaggagcaggcagcatccccaaatgccgagatccacatcctgaagaataaaggccggaagagaaag

SEQ ID NO: 6880 - DNA, 42 bp, Artificial Sequence
  Synthetic oligonucleotide
gtgaaagtagctgggggcttaggctacacctggagcccagaa

SEQ ID NO: 6881 - DNA, 102 bp, Artificial Sequence
  Synthetic oligonucleotide
caactccatgagaagggtgctaatattaccactgggtactgagtagtacctctctttcactagttgcataataagaattaacccagagagtgacctgagggc

SEQ ID NO: 6882 - DNA, 114 bp, Artificial Sequence
  Synthetic oligonucleotide
ctggagtccctggatgccctagagcctgaggagaaggctgaggactgctgggagctacagatcagcccggagctactggctcatgggcgccaaaaaatactggatctgctgaac

SEQ ID NO: 6883 - DNA, 57 bp, Artificial Sequence
  Synthetic oligonucleotide
gaaggctcagcccgagatctccgcagtcttcagcgcattggcccgaagaaggcccag

SEQ ID NO: 6884 - DNA, 42 bp, Artificial Sequence
  Synthetic oligonucleotide
ctaatcgtgggctggcgggagctccacggccccttcagccag

SEQ ID NO: 6885 - DNA, 88 bp, Artificial Sequence
  Synthetic oligonucleotide
gtagcagcccactggactgggggagggcgggggcgggggagaccgggtacccccgagaccctgtcccctatcgatcctgtcccgccag

SEQ ID NO: 6886 - DNA, 21 bp, Artificial Sequence
  Synthetic oligonucleotide
gtggaggacctggaacgcgtg

SEQ ID NO: 6887 - DNA, 39 bp, Artificial Sequence
  Synthetic oligonucleotide
gagggcataacggggaaacagatggagtccttcctgaag

SEQ ID NO: 6888 - DNA, 88 bp, Artificial Sequence
  Synthetic oligonucleotide
gtgaagtcacggccctgcccctcctctgcctgtcctgcgccccgcgcccctctctaacgtcgctgtctccctccctcctgtgttgcag

SEQ ID NO: 6889 - DNA, 107 bp, Artificial Sequence
  Synthetic oligonucleotide
ttctcatagtattccattgattgggtataccaggttctgtttacttttacttggcagttgatagaataggtgtagtttatactttttcgctattctccataccggtg

SEQ ID NO: 6890 - DNA, 27 bp, Artificial Sequence
  Synthetic oligonucleotide
ttctcatagtattccattgattgggta

SEQ ID NO: 6891 - DNA, 21 bp, Artificial Sequence
  Synthetic oligonucleotide
caccggtatggagaatagcga

SEQ ID NO: 6892 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 6893 - DNA, 91 bp, Artificial Sequence
  Synthetic oligonucleotide
tgagagtgattcgcgtgggtacccgcaagagccagcttgctcgcatacagacggacagtgtggtggcaacattgaaagcctcgtaccctgg

SEQ ID NO: 6894 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 6895 - DNA, 94 bp, Artificial Sequence
  Synthetic oligonucleotide
tgacactggcaaaacaatgcagactttgctttccttggtcaggcagtataatccaaagatggtcaaggtcgcaagcttgctggtgaaaaggacc

SEQ ID NO: 6896 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 6897 - DNA, 86 bp, Artificial Sequence
  Synthetic oligonucleotide
tgggaacaagagggcatctgctaaagtttcagattccatttctgctcagtatccagtagtggatcatgaatttgatgcagtggtgg

SEQ ID NO: 6898 - DNA, 2650 bp, Homo sapiens
agggacagcccagaggaggcgtggccacgctgccggcggaagtggagccctccgcgagcgcgcgaggccgccggggcaggcggggaaaccggacagtaggggcggggccgggccggcgatggggatgcgggagcactacgcggagctgcacccgtgcccgccggaattggggatgcagagcagcggcagcgggtatggcaggcagccggcgggccggcctccagcgcaggtgcccgagaggcaggggctggcctgggatgcgcgcgcacctgccctcgccccgccccgcccgcacgaggggtggtggccgaggccccgccccgcacgcctcgcctgaggcgggtccgctcagcccaggcgcccgcccccgcccccgccgattaaatgggccggcggggctcagcccccggaaacggtcgtaacttcggggctgcgagcgcggagggcgacgacgacgaagcgcagacagcgtcatggcagagcaggtggccctgagccggacccaggtgtgcgggatcctgcgggaagagcttttccagggcgatgccttccatcagtcggatacacacatattcatcatcatgggtgcatcgggtgacctggccaagaagaagatctaccccaccatctggtggctgttccgggatggccttctgcccgaaaacaccttcatcgtgggctatgcccgttcccgcctcacagtggctgacatccgcaaacagagtgagcccttcttcaaggccaccccagaggagaagctcaagctggaggacttctttgcccgcaactcctatgtggctggccagtacgatgatgcagcctcctaccagcgcctcaacagccacatggatgccctccacctggggtcacaggccaaccgcctcttctacctggccttgcccccgaccgtctacgaggccgtcaccaagaacattcacgagtcctgcatgagccagataggctggaaccgcatcatcgtggagaagcccttcgggagggacctgcagagctctgaccggctgtccaaccacatctcctccctgttccgtgaggaccagatctaccgcatcgaccactacctgggcaaggagatggtgcagaacctcatggtgctgagatttgccaacaggatcttcggccccatctggaaccgggacaacatcgcctgcgttatcctcaccttcaaggagccctttggcactgagggtcgcgggggctatttcgatgaatttgggatcatccgggacgtgatgcagaaccacctactgcagatgctgtgtctggtggccatggagaagcccgcctccaccaactcagatgacgtccgtgatgagaaggtcaaggtgttgaaatgcatctcagaggtgcaggccaacaatgtggtcctgggccagtacgtggggaaccccgatggagagggcgaggccaccaaagggtacctggacgaccccacggtgccccgcgggtccaccaccgccacttttgcagccgtcgtcctctatgtggagaatgagaggtgggatggggtgcccttcatcctgcgctgcggcaaggccctgaacgagcgcaaggccgaggtgaggctgcagttccatgatgtggccggcgacatcttccaccagcagtgcaagcgcaacgagctggtgatccgcgtgcagcccaacgaggccgtgtacaccaagatgatgaccaagaagccgggcatgttcttcaaccccgaggagtcggagctggacctgacctacggcaacagatacaagaacgtgaagctccctgacgcctacgagcgcctcatcctggacgtcttctgcgggagccagatgcacttcgtgcgcagcgacgagctccgtgaggcctggcgtattttcaccccactgctgcaccagattgagctggagaagcccaagcccatcccctatatttatggcagccgaggccccacggaggcagacgagctgatgaagagagtgggtttccagtatgagggcacctacaagtgggtgaacccccacaagctctgagccctgggcacccacctccacccccgccacggccaccctccttcccgccgcccgaccccgagtcgggaggactccgggaccattgacctcagctgcacattcctggccccgggctctggccaccctggcccgcccctcgctgctgctactacccgagcccagctacattcctcagctgccaagcactcgagaccatcctggcccctccagaccctgcctgagcccaggagctgagtcacctcctccactcactccagcccaacagaaggaaggaggagggcgcccattcgtctgtcccagagcttattggccactgggtctcactcctgagtggggccagggtgggagggagggacaagggggaggaaaggggcgagcacccacgtgagagaatctgcctgtggccttgcccgccagcctcagtgccacttgacattccttgtcaccagcaacatctcgagccccctggatgtcccctgtcccaccaactctgcactccatggccaccccgtgccacccgtaggcagcctctctgctataagaaaagcagacgcagcagctgggacccctcccaacctcaatgccctgccattaaatccgcaaacagccaaaaaaaaaaaaaaaaaaaa

SEQ ID NO: 6899 - DNA, 111 bp, Artificial Sequence
  Synthetic oligonucleotide
gaggccgtcaccaagaacattcacgagtcctgcatgagccagataggctggaaccgcatcatcgtggagaagcccttcgggagggacctgcagagctctgaccggctgtcc

SEQ ID NO: 6900 - DNA, 104 bp, Artificial Sequence
  Synthetic oligonucleotide
attgaataattcagcacctgaggctggtggatgattctttgcaatttggcaggaatgggagagtcgggagcagtagttggcaaggtggggagtagccatatgaa

SEQ ID NO: 6901 - DNA, 24 bp, Artificial Sequence
  Synthetic oligonucleotide
attgaataattcagcacctgaggc

SEQ ID NO: 6902 - DNA, 22 bp, Artificial Sequence
  Synthetic oligonucleotide
ttcatatggctactccccacct

SEQ ID NO: 6903 - DNA, 101 bp, Artificial Sequence
  Synthetic oligonucleotide
acagtttttacttggaaccagccttctgccaagagtctcagtttggttgtgtactcctacaactactatttttggcttgacttccctctccagctcccagt

SEQ ID NO: 6904 - DNA, 24 bp, Artificial Sequence
  Synthetic oligonucleotide
acagtttttacttggaaccagcct

SEQ ID NO: 6905 - DNA, 19 bp, Artificial Sequence
  Synthetic oligonucleotide
actgggagctggagaggga

SEQ ID NO: 6906 - DNA, 101 bp, Artificial Sequence
  Synthetic oligonucleotide
gctgattgtccccatgaaggccagccttgaagcttggtcagtctccctaactgtatgattgatccccacttattgcactacatcactgagttcccgtatgc

SEQ ID NO: 6907 - DNA, 20 bp, Artificial Sequence
  Synthetic oligonucleotide
gctgattgtccccatgaagg

SEQ ID NO: 6908 - DNA, 20 bp, Artificial Sequence
  Synthetic oligonucleotide
tggcatacgggaactcagtg
